(12) United States Patent
Igawa et al.

(10) Patent No.: US 12,195,528 B2
(45) Date of Patent: Jan. 14, 2025

(54) LIGAND-BINDING MOLECULE HAVING ADJUSTABLE LIGAND-BINDING ACTIVITY

(71) Applicant: Chugai Seiyaku Kabushiki Kaisha, Tokyo (JP)

(72) Inventors: Tomoyuki Igawa, Shizuoka (JP); Hiroyuki Ishikawa, Shizuoka (JP); Tatsuya Kawa, Shizuoka (JP)

(73) Assignee: CHUGAI SEIYAKU KABUSHIKI KAISHA, Tokyo (JP)

( * ) Notice: Subject to any disclaimer, the term of this patent is extended or adjusted under 35 U.S.C. 154(b) by 850 days.

(21) Appl. No.: 16/766,600

(22) PCT Filed: Nov. 28, 2018

(86) PCT No.: PCT/JP2018/043692
§ 371 (c)(1),
(2) Date: May 22, 2020

(87) PCT Pub. No.: WO2019/107384
PCT Pub. Date: Jun. 6, 2019

(65) Prior Publication Data
US 2021/0206845 A1 Jul. 8, 2021

(30) Foreign Application Priority Data

Nov. 28, 2017 (JP) ................... 2017-227651
May 30, 2018 (JP) ................... 2018-103691

(51) Int. Cl.
| | |
|---|---|
| *C07K 14/52* | (2006.01) |
| *A61K 39/395* | (2006.01) |
| *A61K 47/68* | (2017.01) |
| *C07K 16/22* | (2006.01) |
| *C07K 16/24* | (2006.01) |
| *C07K 16/28* | (2006.01) |
| *C07K 19/00* | (2006.01) |
| *A61K 39/00* | (2006.01) |

(52) U.S. Cl.
CPC .......... *C07K 16/24* (2013.01); *A61K 39/3955* (2013.01); *A61K 47/68* (2017.08); *C07K 14/52* (2013.01); *C07K 16/22* (2013.01); *C07K 16/241* (2013.01); *C07K 16/244* (2013.01); *C07K 16/2866* (2013.01); *C07K 19/00* (2013.01); *A61K 2039/505* (2013.01); *A61K 2039/55522* (2013.01); *A61K 2039/55527* (2013.01); *C07K 2319/30* (2013.01); *C07K 2319/50* (2013.01)

(58) Field of Classification Search
CPC ............................. C07K 16/28; C07K 16/2866; C07K 16/2803; C07K 16/2839; C07K 16/2851; C07K 16/2896; C07K 16/30; C07K 16/2878; C07K 16/2863; C07K 14/705; C07K 14/70596; C07K 14/70503; C07K 14/70546; C07K 14/70578; C07K 14/71; C07K 14/715; C07K 14/7151; C07K 14/7153; C07K 14/7155; C07K 14/7156; C07K 14/7158; C07K 2319/00; C07K 2319/50; C07K 19/00; C12Q 2521/537

See application file for complete search history.

(56) References Cited

U.S. PATENT DOCUMENTS

| | | | |
|---|---|---|---|
| 7,666,817 | B2 | 2/2010 | Daugherty et al. |
| 7,901,684 | B2 | 3/2011 | Gill et al. |
| 10,011,858 | B2 | 7/2018 | Igawa et al. |
| 10,568,977 | B2 | 2/2020 | Desnoyers et al. |
| 10,696,723 | B2 | 6/2020 | Winston et al. |
| 11,168,139 | B2 | 11/2021 | Igawa et al. |
| 11,932,697 | B2 | 3/2024 | Igawa et al. |
| 12,030,955 | B2 | 7/2024 | Igawa et al. |
| 12,060,654 | B2 | 8/2024 | Igawa et al. |
| 12,077,577 | B2 | 9/2024 | Kitamura et al. |
| 2004/0259768 | A1 | 12/2004 | Lauermann |
| 2007/0065878 | A1 | 3/2007 | Daugherty et al. |
| 2007/0243589 | A1 | 10/2007 | Gill et al. |
| 2010/0015133 | A1 | 1/2010 | Igawa et al. |
| 2011/0064666 | A1 | 3/2011 | Ogawa et al. |
| 2012/0244154 | A1 | 9/2012 | Daugherty et al. |
| 2015/0064169 | A1 | 3/2015 | Wang et al. |
| 2016/0144042 | A1 | 5/2016 | Williams et al. |
| 2016/0194399 | A1 | 7/2016 | Irving et al. |
| 2016/0289324 | A1 | 10/2016 | Moore et al. |
| 2018/0057593 | A1 | 3/2018 | Dennis |
| 2019/0359721 | A1 | 11/2019 | Igawa et al. |

(Continued)

FOREIGN PATENT DOCUMENTS

| | | |
|---|---|---|
| AU | 2016213702 A1 | 8/2016 |
| CA | 2548338 A1 | 6/2005 |

(Continued)

OTHER PUBLICATIONS

Regsiter et al. Genbank Accession No. SBV32674.1; May 15, 2017.*

(Continued)

Primary Examiner — Bridget E Bunner
(74) Attorney, Agent, or Firm — Nixon & Vanderhye P.C.

(57) ABSTRACT

The present invention relates to a ligand-binding molecule the ligand-binding activity of which is attenuated by the cleavage of a cleavage site, a method for producing the ligand-binding molecule, a complex formed by the ligand-binding molecule and a ligand, a fusion protein comprising the ligand-binding molecule and a ligand, and a pharmaceutical composition comprising the ligand-binding molecule or a fusion protein of the ligand-binding molecule and a ligand.

18 Claims, 56 Drawing Sheets

Specification includes a Sequence Listing.

(56) References Cited

U.S. PATENT DOCUMENTS

| | | |
|---|---|---|
| 2019/0367576 A1 | 12/2019 | Winston et al. |
| 2020/0207846 A1 | 7/2020 | Igawa et al. |
| 2020/0369781 A1 | 11/2020 | Igawa et al. |
| 2021/0155701 A1 | 5/2021 | Hoshino et al. |
| 2021/0221875 A1 | 7/2021 | Kitamura et al. |
| 2021/0253672 A1 | 8/2021 | Ishikawa et al. |
| 2022/0073632 A1 | 3/2022 | Igawa et al. |
| 2022/0315909 A1 | 10/2022 | Sakurai et al. |
| 2023/0069996 A1 | 3/2023 | Igawa et al. |
| 2024/0150476 A1 | 5/2024 | Igawa et al. |
| 2024/0270806 A1 | 8/2024 | Chichili et al. |

FOREIGN PATENT DOCUMENTS

| | | |
|---|---|---|
| CA | 2591813 A1 | 6/2006 |
| CA | 2607147 A1 | 11/2006 |
| CA | 2666599 A1 | 2/2008 |
| CA | 2678626 A1 | 9/2008 |
| CA | 2548338 C | 6/2015 |
| CA | 3041279 A1 | 5/2018 |
| CA | 2607147 C | 7/2018 |
| CA | 3083346 A1 | 6/2019 |
| CN | 1665932 A | 9/2005 |
| CN | 101821288 A | 9/2010 |
| CN | 1665932 B | 12/2010 |
| CN | 103068847 A | 4/2013 |
| CN | 103842383 A | 6/2014 |
| CN | 103958547 A | 7/2014 |
| CN | 104661676 A | 5/2015 |
| CN | 106459153 A | 2/2017 |
| CN | 107207564 A | 9/2017 |
| CN | 107602706 A | 1/2018 |
| CN | 111836828 A | 10/2020 |
| CN | 107602706 B | 12/2020 |
| CN | 114127277 A | 3/2022 |
| EP | 1505154 A1 | 2/2005 |
| EP | 2957633 A1 | 12/2015 |
| EP | 3296395 A1 | 3/2018 |
| EP | 3546480 A1 | 10/2019 |
| EP | 3546574 A1 | 10/2019 |
| EP | 3556773 A1 | 10/2019 |
| EP | 3719036 A1 | 10/2020 |
| EP | 3981428 A1 | 4/2022 |
| JP | 2005168328 A | 6/2005 |
| JP | 2010536370 A | 12/2010 |
| JP | 2011026298 A | 2/2011 |
| JP | 2012514982 A | 7/2012 |
| JP | 2013538204 A | 10/2013 |
| JP | 2014509605 A | 4/2014 |
| JP | 2015509952 A | 4/2015 |
| JP | 2015517320 A | 6/2015 |
| JP | 5753903 B2 | 7/2015 |
| JP | 5851842 B2 | 2/2016 |
| JP | 6035009 B2 | 11/2016 |
| JP | 2017523176 A | 8/2017 |
| JP | 2017529853 A | 10/2017 |
| JP | 6273215 B2 | 1/2018 |
| JP | 7020909 B2 | 2/2022 |
| RU | 2583876 C2 | 5/2016 |
| RU | 2015101803 A | 8/2016 |
| RU | 2636046 C2 | 11/2017 |
| WO | WO-2004021861 A2 | 3/2004 |
| WO | WO2005110453 A2 | 11/2005 |
| WO | WO2007027935 A2 | 3/2007 |
| WO | WO-2007063308 A2 | 6/2007 |
| WO | WO2007076933 A1 | 7/2007 |
| WO | WO2008045148 A2 | 4/2008 |
| WO | WO-2008149149 A2 | 12/2008 |
| WO | WO2008157379 A2 | 12/2008 |
| WO | WO-2009021754 A2 | 2/2009 |
| WO | WO-2009025846 A | 2/2009 |
| WO | WO-2010081173 A2 | 7/2010 |
| WO | WO-2010115998 A2 | 10/2010 |
| WO | WO-2011020783 A3 | 4/2011 |
| WO | WO2011123683 A2 | 10/2011 |
| WO | WO-2012025525 A1 | 3/2012 |
| WO | WO2012028697 A1 | 3/2012 |
| WO | WO-2012123755 A1 | 9/2012 |
| WO | WO2012158818 A2 | 11/2012 |
| WO | WO2013046704 A2 | 4/2013 |
| WO | WO-2013128194 A1 | 9/2013 |
| WO | WO-2013148248 A1 | 10/2013 |
| WO | WO-2013176730 A1 | 11/2013 |
| WO | WO2013180834 A2 | 12/2013 |
| WO | WO2013192550 A2 | 12/2013 |
| WO | WO-2014052462 A2 | 4/2014 |
| WO | WO2014125955 A1 | 8/2014 |
| WO | WO2015066279 A2 | 5/2015 |
| WO | WO-2015116933 A2 | 8/2015 |
| WO | WO2015117930 A1 | 8/2015 |
| WO | WO2016014974 A2 | 1/2016 |
| WO | WO-2016016269 A1 | 2/2016 |
| WO | WO-2016046778 A2 | 3/2016 |
| WO | WO2016077505 A2 | 5/2016 |
| WO | WO-2016118629 A1 | 7/2016 |
| WO | WO-2016179003 A1 | 11/2016 |
| WO | WO-2016182064 A1 | 11/2016 |
| WO | WO-2017025698 A1 | 2/2017 |
| WO | WO-2017162587 A1 | 9/2017 |
| WO | WO2017205014 A1 | 11/2017 |
| WO | WO2017220990 A1 | 12/2017 |
| WO | WO2018085555 A1 | 5/2018 |
| WO | WO-2018097307 A1 | 5/2018 |
| WO | WO-2018097308 A1 | 5/2018 |
| WO | WO-2018220225 A1 | 12/2018 |
| WO | WO-2018220236 A1 | 12/2018 |
| WO | WO2019010219 A1 | 1/2019 |
| WO | WO2019010224 A1 | 1/2019 |
| WO | WO2019032471 A1 | 2/2019 |
| WO | WO-2019107380 A1 | 6/2019 |
| WO | WO2019107384 A1 | 6/2019 |
| WO | WO2019132472 A1 | 7/2019 |
| WO | WO2019173832 A2 | 9/2019 |
| WO | WO-2019222294 A1 | 11/2019 |
| WO | WO-2019222295 A1 | 11/2019 |
| WO | WO-2019222296 A1 | 11/2019 |
| WO | WO-2019230866 A1 | 12/2019 |
| WO | WO-2019230867 A1 | 12/2019 |
| WO | WO-2019230868 A1 | 12/2019 |
| WO | WO2020061526 A1 | 3/2020 |
| WO | WO2020069398 A1 | 4/2020 |
| WO | WO2020072821 A2 | 4/2020 |
| WO | WO2020086758 A1 | 4/2020 |
| WO | WO2020246567 A1 | 12/2020 |
| WO | WO2021016640 A1 | 1/2021 |
| WO | WO2021062406 A1 | 4/2021 |
| WO | WO2021149697 A1 | 7/2021 |
| WO | WO2021189139 A1 | 9/2021 |
| WO | WO2021202678 A1 | 10/2021 |
| WO | WO2021212083 A2 | 10/2021 |
| WO | WO2021236676 A1 | 11/2021 |
| WO | WO2022094046 A1 | 5/2022 |
| WO | WO2022155263 A2 | 7/2022 |
| WO | WO2023002952 A1 | 1/2023 |
| WO | WO2023004282 A2 | 1/2023 |
| WO | WO2023043978 A2 | 3/2023 |
| WO | WO2023050006 A1 | 4/2023 |
| WO | WO2023070038 A2 | 4/2023 |
| WO | WO2023242769 A1 | 12/2023 |
| WO | WO2024154744 A1 | 7/2024 |

OTHER PUBLICATIONS

Colman, P. M., "Effects of amino acid sequence changes on antibody-antigen interactions," Res Immunol., 145:33-36 (1994).

Dashivets, T., et al., "Oxidation in the complementarity-determining regions differentially influences the properties of therapeutic antibodies," MAbs, 8(8):1525-1535 (2016).

Hutt, M., et al., "Plasma Half-life Extension of Small Recombinant Antibodies by Fusion to Immunoglobulin-binding Domains," J Biol Chem., 287(7):4462-4469 (2012).

Rudikoff, S., et al., "Single Amino Acid Substitution Altering Antigen-Binding Specificity," PNAS, 79(6):1979-1983 (1982).

(56) References Cited

OTHER PUBLICATIONS

Safdari, Y., et al., "Antibody humanization methods—a review and update," Biotechnol Genet Eng Rev., 29(2):175-186 (2013).
Wei, S., editor, "Chapter 10 Monoclonal Antibody-Based Targeted Therapy on Tumors, Section 1 Research on Engineered Antibody for Treating Tumors," Clinical Tumor Biological Immunotherapy, 186 (2006).
Abstract of ACR/ARHP Annual Meeting, accessed at [https://plan.core-apps.com/tristar_acr17/abstract/7f9a3c05b0ca255af1fc655b034e5eaa], accessed on Apr. 23, 2018.
Alley, S.C., et al., "Antibody-Drug Conjugates: Targeted Drug Delivery for Cancer," Current Opinion in Chemical Biology 14(4):529-537, Elsevier, England (Aug. 2010).
Asano, R. and Kumagai, I., "Functionalization of Bispecific Therapeutic Antibodies Based on Protein Engineering," Yakugaku Zasshi: Journal of the Pharmaceutical Society of Japan 135(7):851-856, Nihon Yakugakkai, Japan (2015).
Baeuerle, P.A., et al., "BiTE: Teaching Antibodies to Engage T-cells for Cancer Therapy," Current Opinion in Molecular Therapeutics 11(1):22-30, Thomson Reuters (Scientific) Ltd, England (Feb. 2009).
Cohen, S.B., et al., "A Randomized, Double-blind Study of AMG 108 (a Fully Human Monoclonal Antibody to IL-1R1) in Patients With Osteoarthritis of the Knee," Arthritis Research & Therapy 13(4):R125, BioMed Central, England (Jul. 2011).
De Bono, J.S., et al., "ING-1, A Monoclonal Antibody Targeting Ep-CAM in Patients With Advanced Adenocarcinomas," Clinical Cancer Research 10(22):7555-7565, The Association, United States (Nov. 2004).
Desjarlais, J.R., et al., "Optimizing Engagement of the Immune System by Anti-Tumor Antibodies: An Engineer's Perspective," Drug Discovery Today 12(21-22):898-910, Elsevier Science Ltd., England (Nov. 2007).
Desnoyers, L.R., et al., "Tumor-specific Activation of an EGFR-targeting Probody Enhances Therapeutic Index," Science Translational Medicine 5(207):207ra144, American Association for the Advancement of Science, United States (Oct. 2013).
Erster, O., et al., "Site-specific targeting of antibody activity in vivo mediated by disease-associated proteases," Journal Controlled Release, 161:804-812 (2012).
Gerspach, J., et al., "Target-Selective Activation of a TNF Prodrug by Urokinase-Type Plasminogen Activator (uPA) Mediated Proteolytic Processing at the Cell Surface," Cancer Immunology, Immunotherapy 55(12):1590-1600, Springer Verlag, Germany (Dec. 2006).
Gladkov, O., et al., "Cyclophosphamide and Tucotuzumab (huKS-IL2) Following First-line Chemotherapy in Responding Patients With Extensive-disease Small-cell Lung Cancer," Anti-Cancer Drugs 26(10):1061-1068, Lippincott Williams & Wilkins, England (Nov. 2015).
Harmsen, M. M., et al., "Selection and optimization of proteolytically stable llama single-domain antibody fragments for oral immunotherapy," Appl Microbiol Biotechnol., 72:544-551 (2006).
Hussack, G., et al., "Engineered Single-Domain Antibodies with High Protease Resistance and Thermal Stability," PLoS One, 6(11):e28218 (2011).
Juszczak, A., et al., "Ipilimumab: A Novel Immunomodulating Therapy Causing Autoimmune Hypophysitis: A Case Report and Review," European Journal of Endocrinology 167(1):1-5, BioScientifica Ltd., England (Jul. 2012).
Kiani, C., et al., "Structure and Function of Aggrecan," Cell Research 12(1):19-32, Nature Publishing Group, England (Mar. 2002).
Kim, S.J., et al., "Antibody Engineering for the Development of Therapeutic Antibodies," Molecules and Cells 20(1):17-29, Korean Society for Molecular and Cellular Biology, Korea (Aug. 2005).
Kromann-Hansen, T., et al., "A Camelid-derived Antibody Fragment Targeting the Active Site of a Serine Protease Balances between Inhibitor and Substrate Behavior," J Biol Chem., 291(29):15156-15168 (2016).

Lewis, G.D., et al., "Differential Responses of Human Tumor Cell Lines to Anti-p185HER2 Monoclonal Antibodies," Cancer Immunology, Immunotherapy 37(4):255-263, Springer Verlag, Germany (Sep. 1993).
Lutterbuese, R., et al., "T Cell-Engaging BiTE Antibodies Specific for EGFR Potently Eliminate KRAS- and BRAF-Mutated Colorectal Cancer Cells," Proceedings of the National Academy of Sciences of the United States of America 107(28):12605-12610, National Academy of Sciences, United States (Jul. 2010).
Martel-Pelletier, J., et al., "Osteoarthritis," Nature Reviews Disease Primers 2:16072, Nature Publishing Group, England (Oct. 2016).
Muller, S., et al., "Spliceosomal Peptide P140 for Immunotherapy of Systemic Lupus Erythematosus," Arthritis Rheum., 58(12):3873-3883 (2008).
Nam, J.L., et al., "Current Evidence for the Management of Rheumatoid Arthritis With Biological Disease-modifying Antirheumatic Drugs: a Systematic Literature Review Informing the EULAR Recommendations for the Management of RA," Annals of the Rheumatic Diseases 69(6):976-986, BMJ, England (Jun. 2010).
Paoloni, M., et al., "Defining the Pharmacodynamic Profile and Therapeutic Index of NHS-IL12 Immunocytokine in Dogs With Malignant Melanoma," PLoS One 10(6):e0129954, Public Library of Science, United States (Jun. 2015).
Papadia, F., et al., "Isolated Limb Perfusion With the Tumor-targeting Human Monoclonal Antibody-cytokine Fusion Protein L19-TNF Plus Melphalan and Mild Hyperthermia in Patients With Locally Advanced Extremity Melanoma," Journal of Surgical Oncology 107(2):173-179, Wiley-Liss, United States (Feb. 2013).
Pavlou, A.K and Belsey, M.J, "The Therapeutic Antibodies Market to 2008," European Journal of Pharmaceutics and Biopharmaceutics, 59(3):389-396, Elsevier Science, Netherlands (Apr. 2005).
Polu, K.R. and Lowman, H.B., "Probody Therapeutics for Targeting Antibodies to Diseased Tissue," Expert Opinion on Biological Therapy 14(8):1049-1053, Taylor & Francis, England (Aug. 2014).
Puskas, J., et al., "Development of an Attenuated Interleukin-2 Fusion Protein That Can be Activated by Tumour-Expressed Proteases," Immunology 133(2):206-220, Blackwell Scientific Publications, England (Jun. 2011).
R&D Systems., "Human Aggrecan G1-IGD-G2 Domains Antibody," Monoclonal Mouse IgG2B Clone # 179509, Catalog No. AF1220, Feb. 2018.
Reichert, J.M., et al., "Monoclonal Antibody Successes in the Clinic," Nature Biotechnology, 23(9):1073-1078, Nature America Publishing, United States (Sep. 2005).
Riechelmann, H., et al., "Phase I Trial With the CD44v6-Targeting Immunoconjugate Bivatuzumab Mertansine in Head and Neck Squamous Cell Carcinoma," Oral Oncology 44(9):823-829, Elsevier, England (Sep. 2008).
Satoh, M., et al., "Non-Fucosylated Therapeutic Antibodies as Next-Generation Therapeutic Antibodies," Expert Opinion on Biological Therapy 6(11):1161-1173, Taylor & Francis, London (Nov. 2006).
Severin, Y. S., editor, "Biochemistry, Textbook for Higher Education," Moscow, GEOTAR-MED, 39-45 (2004).
Takeuchi, T. and Kameda, H., "The Japanese Experience With Biologic Therapies for Rheumatoid Arthritis," Nature Reviews. Rheumatology 6(11):644-652, Nature Pub. Group, United States (Nov. 2010).
Trinh, V.A. and Hwu, W.-J., "Ipilimumab in the Treatment of Melanoma," Expert Opinion on Biological Therapy 12(6):773-782, Taylor & Francis, England (Jun. 2012).
Turk, B.E., et al., "Determination of Protease Cleavage Site Motifs Using Mixture-based Oriented Peptide Libraries," Nature Biotechnology 19(7):661-667, Nature America Publishing, United States (Jul. 2001).
Tzeng, A., et al., "Antigen Specificity Can be Irrelevant to Immunocytokine Efficacy and Biodistribution," Proceedings of the National Academy of Sciences of the United States of America 112(11):3320-3325, National Academy of Sciences, United States (Mar. 2015).
Van Roy, M., et al., "The preclinical pharmacology of the high affinity anti-IL-6R Nanobody ALX-0061 supports its clinical development in rheumatoid arthritis," Arthritis Res Ther., 17:135 (2015).

(56) References Cited

OTHER PUBLICATIONS

Vignali, D. A. A. and Kuchroo, V. K., "IL-12 Family Cytokines: Immunological Playmakers," Nat Immunol., 13(8):722-728 (2012).
Weiner, L.M., et al., "Monoclonal Antibodies: Versatile Platforms for Cancer Immunotherapy," Nature Reviews. Immunology, 10(5):317-327, Nature Publishing Group, England (May 2010).
Wuest, T., et al., "TNF-Selectokine: A Novel Prodrug Generated for Tumor Targeting and Site-specific Activation of Tumor Necrosis Factor," Oncogene 21(27):4257-4265, Nature Publishing Group, England (Jun. 2002).
Xia, B., et al., "Osteoarthritis Pathogenesis: A Review of Molecular Mechanisms," Calcified Tissue International 95(6):495-505, Springer Verlag, United States (Dec. 2014).
Yamane, B. H., et al., "The development of antibody-IL-2 based immunotherapy with hu14.18-IL2 (EMD-273063) in melanoma and neuroblastoma," Expert Opin Investig Drugs, 18(7):991-1000 (2009).
U.S. Appl. No. 16/463,218, filed Nov. 28, 2017, Igawa, T. et al., related application.
U.S. Appl. No. 16/463,222, filed Nov. 28, 2017, Igawa, T. et al., related application.
U.S. Appl. No. 16/767,085, filed Nov. 28, 2018, Igawa, T. et al., related application.
U.S. Appl. No. 17/058,889, filed Nov. 25, 2020, Hoshino, M. et al., related application.
U.S. Appl. No. 17/058,896, filed Nov. 25, 2020, Ishikawa, H. et al., related application.
U.S. Appl. No. 17/058,961, filed Nov. 25, 2020, Kitamura, H. et al., related application.
Acchione, M., et al., "Impact of linker and conjugation chemistry on antigen binding, Fc receptor binding and thermal stability of model antibody-drug conjugates," mAbs, 3:362-372 (2012).
Halin, C., et al., "Synergistic Therapeutic Effects of a Tumor Targeting Antibody Fragment, Fused to Interleukin 12 and to Tumor Necrosis Factor α," Cancer Res., 63:3202-3210 (2003).
Ishii, A., et al., "A receptor involved in the regulation of the pharmacokinetics of antibody-based pharmaceuticals: FcRn," Nihon Yakurigaku Zasshi. Folia Pharmacologica Japonica, 136(5):280-284 (2010).
Knauf, M. J., et al., "Relationship of Effective Molecular Size to Systemic Clearance in Rats of Recombinant Interleukin-2 Chemically Modified with Water-soluble Polymers," J Biol Chem., 263(29):15064-15070 (1988).
Neri, D., et al., "Immunocytokines for cancer treatment: past, present and future," Curr Opin Immunol., 40:96-102 (2016).
Roitt, I., et al., Immunology, Moscow, Mir, 109-111 (2000), with corresponding English translation, Roitt, I., et al., Immunology, 5th Edition, 78-81 (1998).
Sandersjoo, L., et al., "A New Prodrug Form of Affibody Molecules (Pro-affibody) is Selectively Activated by Cancer-associated Proteases," Cellular and Molecular Life Sciences, 72(7):1405-1415 (2015).
Schlapschy, M., et al., "Fusion of a recombinant antibody fragment with a homo-amino-acid polymer: effects on biophysical properties and prolonged plasma half-life," Prot Eng Des Sel., 20(6):273-284 (2007).
Seliverstov, et al., "Spinal Muscular Atrophies: Conception," Differential Diagnostics and Prospects for Treatment, 3:9-17 (2015).
Skrombolas, D., et al., "Development of an Interleukin-12 Fusion Protein That is Activated by Cleavage with Matrix Metalloproteinase 9," Journal of Interferon & Cytokine Research, 39(4):233-245 (2019).
Thomas, D.A., et al., "A Broad-spectrum Fluorescence-based Peptide Library for the Rapid Identification of Protease Substrates," Proteomics, 6(7):2112-2120 (2006).
Torres, M. and Casadevall, A., "The immunoglobulin constant region contributes to affinity and specificity," Trends in Immunol., 29(2):91-97 (2008).
U.S. Appl. No. 17/477,983, filed Sep. 17, 2021, Igawa et al., related application.
U.S. Appl. No. 17/615,633, filed Dec. 1, 2021, Sakurai et al., related application.
U.S. Appl. No. 17/793,587, filed Jul. 18, 2022, Igawa et al., related application.
Abi-Habib, R. J., et al., "A urokinase-activated recombinant diphtheria toxin targeting the granulocyte-macrophage colony-stimulating factor receptor is selectively cytotoxic to human acute myeloid leukemia blasts," Blood, 104(7):2143-2148 (2004).
Alberts, B., et al., "Molecular Biology of the Cell," Fifth Edition, Chapter 3 "Proteins," 125, 136 (2008).
Chen, X., et al., "Fusion Protein Linkers: Property, Design and Functionality," Adv Drug Deliv Rev., 65(10):1357-1369 (2013).
Derksen, P. W. B., et al., "Illegitimate WNT signaling promotes proliferation of multiple myeloma cells," PNAS, 101(16):6122-6127 (2004).
Dirks, P. B., "Brain Tumor Stem Cells: Bringing Order to the Chaos of Brain Cancer," J Clin Oncol., 26(17):2916-2924 (2008).
Drutskaya, M. S., et al., "Role of IL-6 in Experimental Arthritis Induced by Transfer of Arthritogenic Antibodies," Medical Immunology (Russia), 18(6):569-574 (2016).
Ginaldi, L., et al., "Increased levels of interleukin 31 (IL-31) in osteoporosis," BMC Immunol., 16:60 (2015).
Keskin, O., et al., "A new, structurally nonredundant, diverse data set of protein-protein interfaces and its implications," Protein Sci., 13:1043-1055 (2004).
López-Lázaro, M., "The migration ability of stem cells can explain the existence of cancer of unknown primary site. Rethinking metastasis." Oncoscience, 2(5):467-475 (2015).
Maeda, Y., et al., "Engineering of Functional Chimeric Protein G-VargulaLuciferase," Anal Biochem., 249(2):147-152 (1997).
Office Action dated May 24, 2023 in U.S. Appl. No. 16/767,085, filed May 26, 2020, Igawa et al.
Restriction Requirement dated Sep. 22, 2022 in U.S. Appl. No. 16/767,085, filed May 26, 2020, Igawa et al.
Takamori, A., et al., "IL-31 is crucial for induction of pruritus, but not inflammation, in contact hypersensitivity," Sci Rep., 8:6639 (2018).
Tran, B. and Rosenthal, M. A., "Survival comparison between glioblastoma multiforme and other incurable cancers," J Clin Neurosci., 17:417-421 (2010).
U.S. Appl. No. 18/393,918, filed Dec. 22, 2023, Igawa et al., related application.
Onuoha, S. C., et al., "Rational Design of Antirheumatic Prodrugs Specific for Sites of Inflammation," Arthritis Rheumatol., 67(10):2661-2672 (2015).
Allegra, C. J., et al., "Phase III Trial Assessing Bevacizumab in Stages II and III Carcinoma of the Colon: Results of NSABP Protocol C-08," J Clin Oncol., 29(1):11-16 (2011).
Badri, H., et al., "Optimization of radiation dosing schedules for proneural glioblastoma," J Math Biol., 72:1301-1336 (2016).
Baylot, V., et al., "TCTP Has a Crucial Role in the Different Stages of Prostate Cancer Malignant 4 Progression 5," TCTP/tpt1—Remodeling Signaling from Stem Cell to Disease. Results and Problems in Cell Differentiation, 64:255-261 (2017).
Mariuzza, R. A., et al., "The Structural Basis of Antigen-Antibody Recognition," Ann Rev Biophys Biophys Chem., 16:139-159 (1987).
Qin, Z.-X. and Liu, Z.-M., "The Research Progress in Yapsin Protease Family," Letters in Biotechnology, 19(4):591-596 (2008), with English abstract.
Restriction Requirement dated Apr. 1, 2024 in U.S. Appl. No. 17/058,896, filed Nov. 25, 2020, Ishikawa et al.
Roitt, I., et al., "Immunology," Fifth Edition, Moscow, Mir, 97-113 (2000).
Singer, M. and Berg, P., "Genes and Genomes," Moscow, Mir, 63 (1998).
Yarilin, A. A., Immunology Basics: Manual, Fundamentals of Immunology, Moscow, Medicina, 172-174 (1999).
U.S. Appl. No. 11/910,128, filed Oct. 7, 2008, Igawa et al.
U.S. Appl. No. 18/414,813, filed Jan. 17, 2024, Chichili et al., related application.
U.S. Appl. No. 18/580,385, filed Jan. 18, 2024, Chichili et al., related application.
U.S. Appl. No. 18/656,351, filed May 6, 2024, Igawa et al., related application.

(56) References Cited

OTHER PUBLICATIONS

U.S. Appl. No. 18/672,417, filed May 23, 2024, Igawa et al., related application.

* cited by examiner (A)

Protease cleavage sequence Heavy chain

Insertion position. name: C D A E B F G

Sequence: T V S S A S T K G

Protease cleavage sequence **Light ch ( B ) Heavy chain

| Heavy chain variant name | Protease cleavage sequence insertion position | Inserted sequence |
|---|---|---|
| EEIVHA | TVSS [insert] ASTKGP | LSGRSDNH (SEQ ID NO: 3) |
| EEIVHB | TVSSAS [insert] TKGP | LSGRSDNH (SEQ ID NO: 3) |
| EEIVHC | TV [insert] SSASTKGP | LSGRSDNH (SEQ ID NO: 3) |
| EEIVHD | TVS [insert] SASTKGP | LSGRSDNH (SEQ ID NO: 3) |
| EEIVHE | TVSSA [insert] STKGP | LSGRSDNH (SEQ ID NO: 3) |
| EEIVHF | TVSSAST [insert] KGP | LSGRSDNH (SEQ ID NO: 3) |
| EEIVHG | TVSSASTK [insert] GP | LSGRSDNH (SEQ ID NO: 3) |
| EEIVHBG | TVSSAS [insert] GKGP | LSGRSDNH (SEQ ID NO: 3) |
| EEIVHCG | TV [insert] GSASTKGP | LSGRSDNH (SEQ ID NO: 3) |
| EEIVHDG | TVS [insert] GASTKGP | LSGRSDNH (SEQ ID NO: 3) |
| EEIVHEG | TVSSA [insert] GTKGP | LSGRSDNH (SEQ ID NO: 3) |

FIG. 5B ( C ) Light chain

| Light chain variant name | Protease cleavage sequence insertion position | Inserted sequence |
|---|---|---|
| EEIVLA | VDIK [insert] RTVAAP | LSGRSDNH (SEQ ID NO: 3) |
| EEIVLB | VDIKRT [insert] VAAP | LSGRSDNH (SEQ ID NO: 3) |
| EEIVLC | VD [insert] IKRTVAAP | LSGRSDNH (SEQ ID NO: 3) |
| EEIVLD | VDI [insert] KRTVAAP | LSGRSDNH (SEQ ID NO: 3) |
| EEIVLE | VDIKR [insert] TVAAP | LSGRSDNH (SEQ ID NO: 3) |
| EEIVLF | VDIKRTV [insert] AAP | LSGRSDNH (SEQ ID NO: 3) |
| EEIVLG | VDIKRTVA [insert] AP | LSGRSDNH (SEQ ID NO: 3) |
| EEIVLEG | VDIKR [insert] GVAAP | LSGRSDNH (SEQ ID NO: 3) |

| Heavy chain variant name | Protease cleavage sequence insertion position | Inserted sequence |
|---|---|---|
| EEIVHC | TV [insert] SSASTKGP | LSGRSDNH (SEQ ID NO: 3) |
| EEIVHC002 | TV [insert] SSASTKGP | GLSGRSDNHG (SEQ ID NO: 28) |
| EEIVHC003 | TV [insert] SSASTKGP | SGLSGRSDNHGS (SEQ ID NO: 29) |
| EEIVHC004 | TV [insert] SSASTKGP | GSGLSGRSDNHGSS (SEQ ID NO: 30) |
| EEIVHC005 | TV [insert] SSASTKGP | GGSGLSGRSDNHGSSG (SEQ ID NO: 31) |
| EEIVHC006 | TV [insert] SSASTKGP | SGGSGLSGRSDNHGSSGT (SEQ ID NO: 32) |

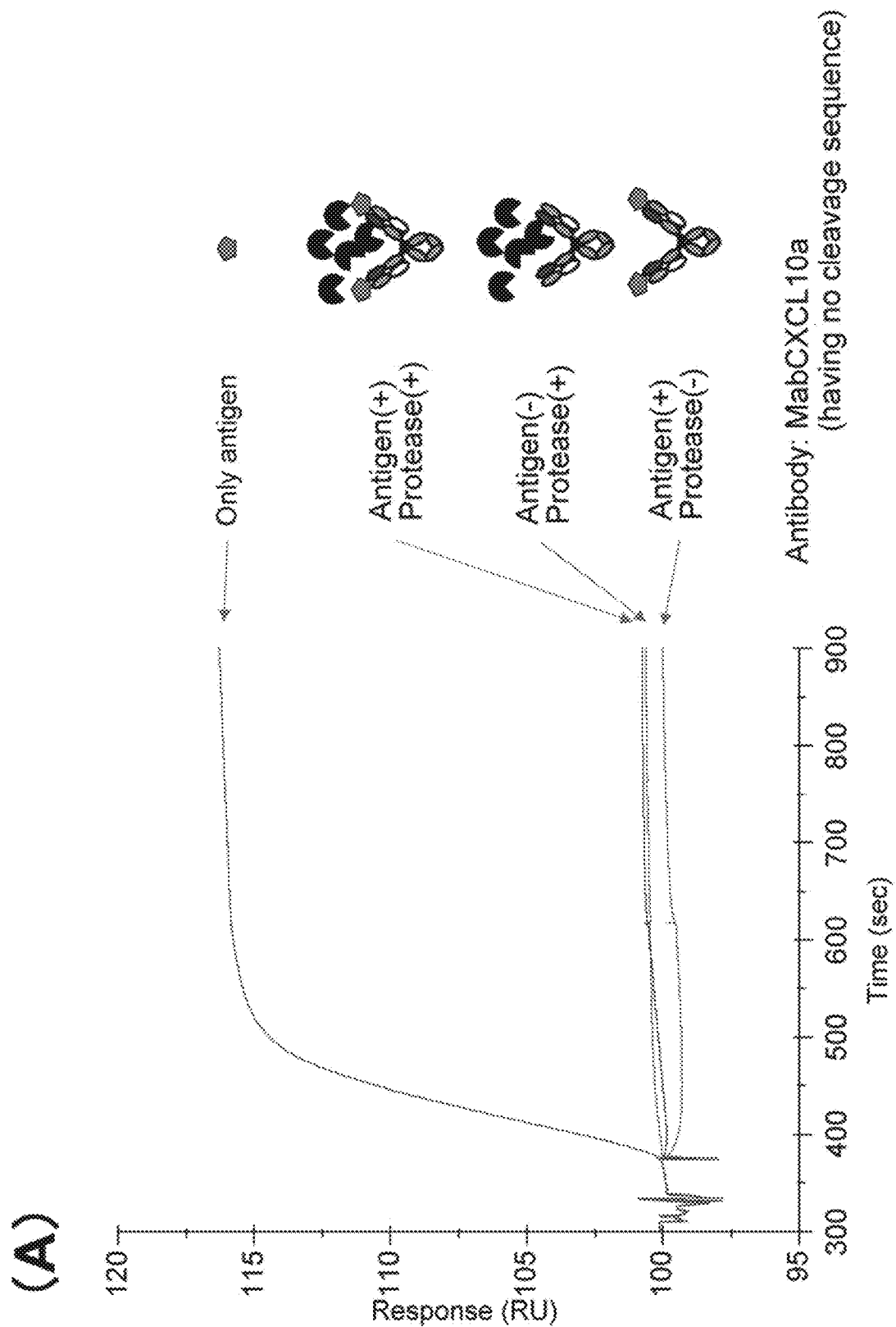

| Heavy chain variant name | Insertion position and alteration position | Inserted sequence | Sequence after insertion and alteration |
|---|---|---|---|
| EESVHA009 | TVSS [insert] A-STKGP | GLSGRSDNHGS (SEQ ID NO: 61) | TVSSGLSGRSDNHGSSTKGP (SEQ ID NO: 62) |
| EESVHA012 | TVSS [insert] A-STKGP | GGSGLSGRSDNHGSSGT (SEQ ID NO: 63) | TVSSGGSGLSGRSDNHGSSGTSTKGP (SEQ ID NO: 64) |

FIG. 12

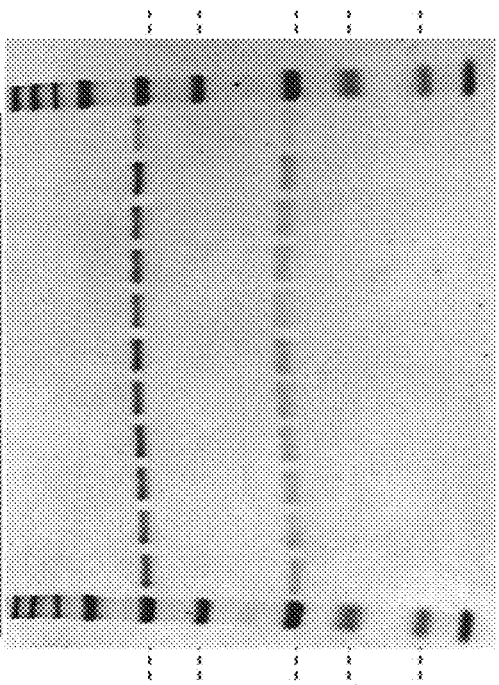
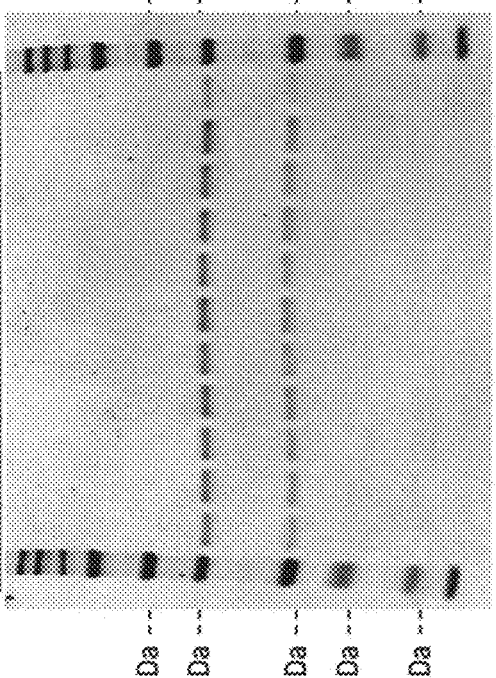
FIG. 19A

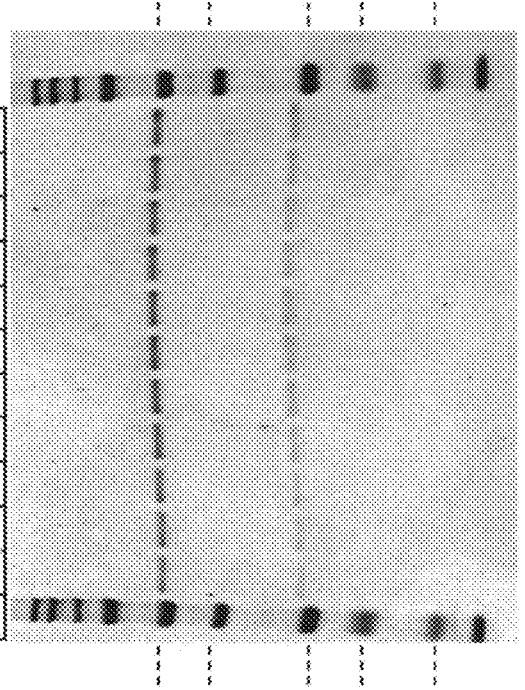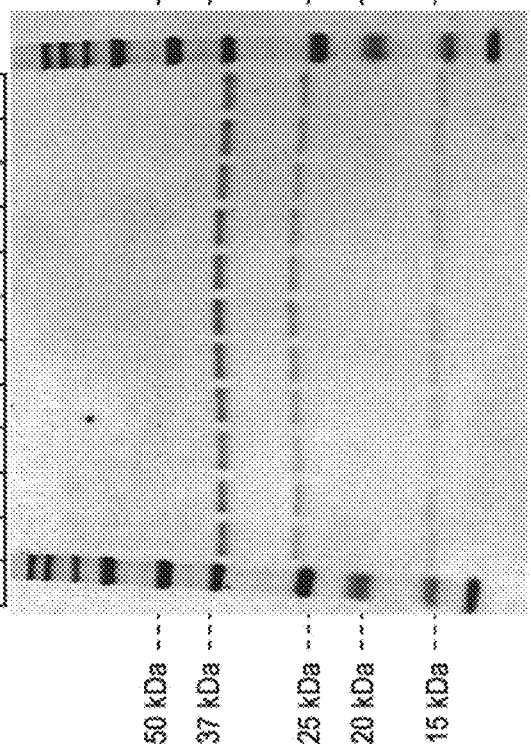
FIG. 19B

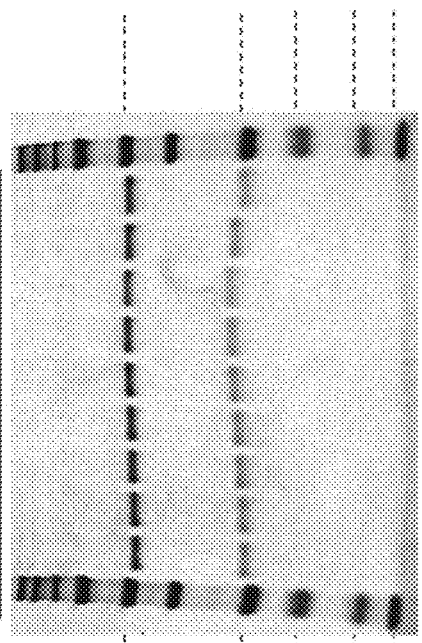
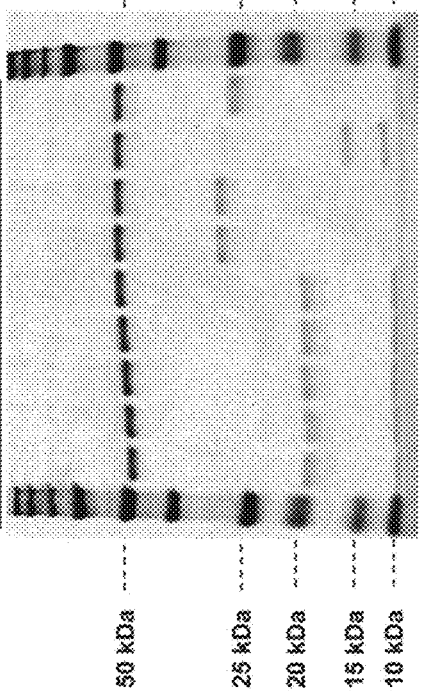
FIG. 24C

LIGAND-BINDING MOLECULE HAVING ADJUSTABLE LIGAND-BINDING ACTIVITY

CROSS-REFERENCE TO RELATED APPLICATIONS

This application is a U.S. National Phase of PCT Application No. PCT/JP2018/043692, filed Nov. 28, 2018, which claims the benefit of Japanese Patent Application No. 2017-227651, filed Nov. 28, 2017, and Japanese Patent Application No. 2018-103691, filed May 30, 2018, each of which is incorporated herein by reference in its entirety.

REFERENCE TO SEQUENCE LISTING SUBMITTED ELECTRONICALLY

The content of the electronically submitted sequence listing (Name: 6663_0138 Sequence_Listing.txt; Size: 1418371 bytes; and Date of Creation: May 22, 2020) filed with the application is incorporated herein by reference in its entirety.

TECHNICAL FIELD

The present invention provides a ligand-binding molecule which has at least one cleavage site and the binding of which to the ligand is attenuated in a state where the cleavage site is cleaved, a method for producing the ligand-binding molecule, and a pharmaceutical composition comprising the ligand-binding molecule.

BACKGROUND ART

Antibodies have been receiving attention as drugs because they are highly stable in plasma and cause few adverse reactions. In particular, many IgG-type antibody drugs have been on the market, and a large number of antibody drugs are currently under development (Non Patent Literatures 1 and 2).

Antibody-based cancer therapeutic drugs that have previously been approved include Rituxan, cetuximab, and Herceptin, which are directed against CD20 antigen, EGFR antigen, and HER2 antigen, respectively (Non Patent Literature 3). These antibody molecules bind to their antigens expressed on cancer cells and thereby exert cytotoxic activity against the cancer cells through ADCC, signal inhibition, etc.

Meanwhile, a method for delivering a biologically active ligand such as a cytokine to solid cancer is known, which uses an immunocytokine prepared by fusing such a ligand with an antibody molecule that binds to a cancer antigen highly expressed on cancer cells. The cytokine delivered to solid cancer by the immunocytokine activates immunity and thereby exerts an antitumor effect. Since cytokines including IL-2, IL-12, and TNF are very toxic, delivering these cytokines locally to cancer using an antibody to allow them to act locally on the cancer is expected to provide enhanced effects with alleviated adverse reactions (Non Patent Literatures 4, 5, and 6). However, none of these molecules have yet been approved as drugs because of their problems such as poor clinical effect in systemic administration, narrow therapeutic windows, and being too toxic to be administered systemically.

This is largely because cytokines, including immunocytokines, are exposed to the whole body after systemic administration and therefore may act and exhibit toxicity in a systemic manner, or can only be administered at very low doses in order to circumvent the toxicity. It has also been reported that there was no difference in antitumor effect between an immunocytokine composed of IL-2 fused with an antibody that binds to a cancer antigen and an immunocytokine composed of IL-2 fused with an antibody that does not bind to the cancer antigen (Non Patent Literature 7).

As a means to circumvent the above-described problems, a molecule composed of a cytokine connected with a cytokine receptor via a linker that is cleaved by protease highly expressed in cancer has been reported. The cytokine is inhibited by the cytokine receptor connected therewith via the linker, but, upon protease cleavage of the linker, the cytokine is liberated from the cytokine receptor and thereby becomes an active form. For example, a molecule in which TNF-alpha and TNF-R are connected via a linker that is cleaved by uPA (Non Patent Literature 8) has been reported, and a molecule in which IL-2 and IL-2R are connected via a linker that is cleaved by MMP-2 (Non Patent Literature 9) has been reported. However, the cytokines in these molecules are active even before cleavage of the linker, and the cleavage of the linker improves the activity by only approximately 10 times. Meanwhile, a molecule in which IL-2 is connected with anti-IL-2 scFv instead of IL-2R via a linker that is cleaved by MMP-2 (Non Patent Literature 9) has been reported.

CITATION LIST

Non Patent Literature

[NPL 1] Monoclonal antibody successes in the clinic. Janice M Reichert, Clark J Rosensweig, Laura B Faden & Matthew C Dewitz, Nat. Biotechnol. (2005) 23, 1073-1078

[NPL 2] The therapeutic antibodies market to 2008. Pavlou A K, Belsey M J., Eur. J. Pharm. Biopharm. (2005) 59 (3), 389-396

[NPL 3] Monoclonal antibodies: versatile platforms for cancer immunotherapy. Weiner L M, Surana R, Wang S., Nat. Rev. Immunol. (2010) 10 (5), 317-327

[NPL 4] Cyclophosphamide and tucotuzumab (huKS-IL2) following first-line chemotherapy in responding patients with extensive-disease small-cell lung cancer. Gladkov O, Ramlau R, Serwatowski P, Milanowski J, Tomeczko J, Komarnitsky P B, Kramer D, Krzakowski M J. Anticancer Drugs. 2015 November; 26 (10): 1061-8.

[NPL 5] Defining the Pharmacodynamic Profile and Therapeutic Index of NHS-IL12 Immunocytokine in Dogs with Malignant Melanoma. Paoloni M, Mazcko C, Selting K, Lana S, Barber L, Phillips J, Skorupski K, Vail D, Wilson H, Biller B, Avery A, Kiupel M, LeBlanc A, Bernhardt A, Brunkhorst B, Tighe R, Khanna C. PLOS One. 2015 Jun. 19; 10 (6): e0129954.

[NPL 6] Isolated limb perfusion with the tumor-targeting human monoclonal antibody-cytokine fusion protein L19-TNF plus melphalan and mild hyperthermia in patients with locally advanced extremity melanoma. Papadia F, Basso V, Patuzzo R, Maurichi A, Di Florio A, Zardi L, Ventura E, Gonzalez-Iglesias R, Lovato V, Giovannoni L, Tasciotti A, Neri D, Santinami M, Menssen H D, De Cian F. J Surg Oncol. 2013 February; 107 (2): 173-9.

[NPL 7] Antigen specificity can be irrelevant to immunocytokine efficacy and biodistribution. Tzeng A, Kwan B H, Opel C F, Navaratna T, Wittrup K D. Proc Natl Acad Sci USA. 2015 Mar. 17; 112 (11): 3320-5.

[NPL 8] Cancer Immunol Immunother. 2006 December; 55 (12): 1590-600. Epub 2006 Apr. 25. Target-selective activation of a TNF prodrug by urokinase-type plasminogen activator (uPA) mediated proteolytic processing at the cell surface. Gerspach J1, Nemeth J, Munkel S, Wajant H, Pfizenmaier K.

[NPL 9] Immunology. 2011 June; 133 (2): 206-20. doi: 10.1111/j.1365-2567.2011.03428.x. Epub 2011 Mar. 23. Development of an attenuated interleukin-2 fusion protein that can be activated by tumour-expressed proteases. Puskas J 1, Skrombolas D, Sedlacek A, Lord E, Sullivan M, Frelinger J.

SUMMARY OF INVENTION

Technical Problem

The present invention has been made in light of these circumstances. An object of the present invention is to provide a ligand-binding molecule that activates a ligand such as a cytokine or a chemokine selectively in a target tissue, a pharmaceutical composition comprising the ligand-binding molecule, and methods for producing the pharmaceutical composition and the active ingredient.

Solution to Problem

The present inventors conducted diligent studies to attain the object and developed a ligand-binding molecule whose ligand binding activity is attenuated by the cleavage of a cleavage site. The present inventors also found that the ligand-binding molecule or a pharmaceutical composition comprising the ligand-binding molecule is useful for treating a disease by using the ligand, that the ligand-binding molecule or the pharmaceutical composition is useful for treating a disease comprising administering the ligand-binding molecule, and that the ligand-binding molecule is useful for producing a medicament for the treatment of a disease. The present inventors also developed a method for producing the ligand-binding molecule and thus completed the present invention.

The present invention is based on the above findings and specifically encompasses exemplary embodiments described below.

(1) A ligand-binding molecule, which is a molecule capable of binding to a ligand, wherein the molecule is a polypeptide having at least one cleavage site and the binding of which to the ligand is attenuated in a state where the molecule is cleaved at at least one cleavage site.

(2) The ligand-binding molecule according to (1), wherein the ligand is released from the ligand-binding molecule in a state where the cleavage site is cleaved.

(3) The ligand-binding molecule according to (1) or (2), wherein the cleavage site comprises a protease cleavage sequence.

(4) The ligand-binding molecule according to (3), wherein the protease is a target tissue specific protease.

(5) The ligand-binding molecule according to (4), wherein the target tissue is a cancer tissue, and the target tissue specific protease is a cancer tissue specific protease.

(6) The ligand-binding molecule according to (4), wherein the target tissue is an inflammatory tissue, and the target tissue specific protease is an inflammatory tissue specific protease.

(7) The ligand-binding molecule according to any of (3) to (6), wherein the protease is at least one protease selected from matriptase, urokinase (uPA), and metalloprotease.

(8) The ligand-binding molecule according to (3), wherein the protease cleavage sequence is a sequence comprising a sequence selected from the sequences represented by SEQ ID NOs: 3, 34, 66, 70, 71, 72, 73, 35, 75, 76, 335 to 345, 1161 to 1180, 1392 to 1411, and the sequences set forth in Table 1.

(9) The ligand-binding molecule according to any of (3) to (8), wherein a first flexible linker is further attached to one end of the protease cleavage sequence.

(10) The ligand-binding molecule according to (9), wherein a second flexible linker is further attached to the other end of the protease cleavage sequence.

(11) The ligand-binding molecule according to (9), wherein the first flexible linker is a flexible linker consisting of a glycine-serine polymer.

(12) The ligand-binding molecule according to (10), wherein the second flexible linker is a flexible linker consisting of a glycine-serine polymer.

(13) The ligand-binding molecule according to any of (1) to (12), wherein the ligand-binding molecule comprises antibody VH, antibody VL, and an antibody constant region.

(14) The ligand-binding molecule according to (13), wherein the cleavage site, or the protease cleavage sequence, or the protease cleavage sequence and the first flexible linker, or the protease cleavage sequence and the first flexible linker and the second flexible linker is located within the antibody constant region.

(15) The ligand-binding molecule according to (14), wherein the cleavage site, or the protease cleavage sequence, or the protease cleavage sequence and the first flexible linker, or the protease cleavage sequence and the first flexible linker and the second flexible linker is inserted into any position within the sequence from amino acid 118 in the antibody heavy chain constant region (EU numbering) to amino acid 140 in the antibody heavy chain constant region (EU numbering).

(16) The ligand-binding molecule according to (14), wherein the cleavage site, or the protease cleavage sequence, or the protease cleavage sequence and the first flexible linker, or the protease cleavage sequence and the first flexible linker and the second flexible linker is inserted into any position within the sequence from amino acid 108 in the antibody light chain constant region (EU numbering) (Kabat numbering position 108) to amino acid 131 in the antibody light chain constant region (EU numbering) (Kabat numbering position 131).

(17) The ligand-binding molecule according to (13), wherein the cleavage site, or the protease cleavage sequence, or the protease cleavage sequence and the first flexible linker, or the protease cleavage sequence and the first flexible linker and the second flexible linker are located within the antibody VH or within the antibody VL.

(18) The ligand-binding molecule according to (17), wherein the cleavage site, or the protease cleavage sequence, or the protease cleavage sequence and the first flexible linker, or the protease cleavage sequence and the first flexible linker and the second flexible linker is inserted into any position within a sequence selected from the group consisting of amino acid 7

(Kabat numbering) to amino acid 16 (Kabat numbering), amino acid 40 (Kabat numbering) to amino acid 47 (Kabat numbering), amino acid 55 (Kabat numbering) to amino acid 69 (Kabat numbering), amino acid 73 (Kabat numbering) to amino acid 79 (Kabat numbering), amino acid 83 (Kabat numbering) to amino acid 89 (Kabat numbering), amino acid 95 (Kabat numbering) to amino acid 99 (Kabat numbering), and amino acid 101 (Kabat numbering) to amino acid 113 (Kabat numbering) in the antibody VH.
(19) The ligand-binding molecule according to (17), wherein the cleavage site, or the protease cleavage sequence, or the protease cleavage sequence and the first flexible linker, or the protease cleavage sequence and the first flexible linker and the second flexible linker is inserted into any position within a sequence selected from the group consisting of amino acid 7 (Kabat numbering) to amino acid 19 (Kabat numbering), amino acid 39 (Kabat numbering) to amino acid 46 (Kabat numbering), amino acid 49 (Kabat numbering) to amino acid 62 (Kabat numbering), and amino acid 96 (Kabat numbering) to amino acid 107 (Kabat numbering) in the antibody VL.
(20) The ligand-binding molecule according to (13), wherein the cleavage site, or the protease cleavage sequence, or the protease cleavage sequence and the first flexible linker, or the protease cleavage sequence and the first flexible linker and the second flexible linker is located near the boundary between the antibody constant region and the antibody VH or/and near the boundary between the antibody constant region and the antibody VL.
(21) The ligand-binding molecule according to (20), wherein the cleavage site, or the protease cleavage sequence, or the protease cleavage sequence and the first flexible linker, or the protease cleavage sequence and the first flexible linker and the second flexible linker is inserted at an arbitrary position of a sequence from antibody VH amino acid position 109 (Kabat numbering) to antibody heavy chain constant region amino acid position 122 (EU numbering).
(22) The ligand-binding molecule according to (20), wherein the cleavage site, or the protease cleavage sequence, or the protease cleavage sequence and the first flexible linker, or the protease cleavage sequence and the first flexible linker and the second flexible linker is inserted at an arbitrary position of a sequence from antibody VL amino acid position 104 (Kabat numbering) to antibody light chain constant region amino acid position 113 (EU numbering) (Kabat numbering position 113).
(23) The ligand-binding molecule according to any of (13) to (22), wherein the antibody VL and the antibody VH in the ligand-binding molecule are associated with each other, wherein the association is eliminated by cleavage of the cleavage site or eliminated by cleavage of the protease cleavage sequence with the protease.
(24) The ligand-binding molecule according to any of (1) to (23), wherein the ligand is a biologically active molecule, and wherein the ligand-binding molecule inhibits the biological activity of the ligand by binding to the ligand.
(25) The ligand-binding molecule according to any of (1) to (24), wherein the ligand is a cytokine or a chemokine.
(26) The ligand-binding molecule according to any of (1) to (24), wherein the ligand is a ligand selected from an interleukin, an interferon, a hematopoietic factor, a TNF superfamily, a chemokine, a cell growth factor, and a TGF-β family.
(27) The ligand-binding molecule according to any of (1) to (24), wherein the ligand is CXCL10, IL-12, PD-1, or IL-6R.
(28) The ligand-binding molecule according to (27), wherein the ligand is CXCL10, and wherein the ligand-binding molecule comprises antibody VH and antibody VL, and the ligand-binding molecule has:
 (a) antibody VH comprising H-CDR1 shown in SEQ ID NO: 374, H-CDR2 shown in SEQ ID NO: 375, and H-CDR3 shown in SEQ ID NO: 376, and antibody VL comprising L-CDR1 shown in SEQ ID NO: 377, L-CDR2 shown in SEQ ID NO: 378, and L-CDR3 shown in SEQ ID NO: 379;
 (b) antibody VH comprising H-CDR1 shown in SEQ ID NO: 380, H-CDR2 shown in SEQ ID NO: 381, and H-CDR3 shown in SEQ ID NO: 382, and antibody VL comprising L-CDR1 shown in SEQ ID NO: 383, L-CDR2 shown in SEQ ID NO: 384, and L-CDR3 shown in SEQ ID NO: 385;
 (c) antibody VH and antibody VL that compete with (a) or (b); or
 (d) antibody VH and antibody VL that bind to the same epitope as that for (a) or (b).
(29) The ligand-binding molecule according to (28), wherein the ligand-binding molecule is an antibody comprising an antibody heavy chain selected from the sequences represented by SEQ ID NOs: 4 to 14, 23 to 27, 33, 59, 60, and 346 to 367, or an antibody light chain selected from the sequences represented by SEQ ID NOs: 15 to 22, 1146 to 1160, 1282 to 1380, and 1386 to 1389.
(30) The ligand-binding molecule according to (27), wherein the ligand is IL-12, and wherein the ligand-binding molecule comprises antibody VH and antibody VL, and the ligand-binding molecule has:
 (a) antibody VH comprising H-CDR1 shown in SEQ ID NO: 386, H-CDR2 shown in SEQ ID NO: 387, and H-CDR3 shown in SEQ ID NO: 388, and antibody VL comprising L-CDR1 shown in SEQ ID NO: 389, L-CDR2 shown in SEQ ID NO: 390, and L-CDR3 shown in SEQ ID NO: 391;
 (b) antibody VH and antibody VL that compete with (a); or
 (c) antibody VH and antibody VL that bind to the same epitope as that for (a).
(31) The ligand-binding molecule according to (30), wherein the ligand-binding molecule is an antibody comprising an antibody heavy chain shown in SEQ ID NO: 146.
(32) The ligand-binding molecule according to (27), wherein the ligand is PD-1, and wherein the ligand-binding molecule comprises antibody VH and antibody VL, and the ligand-binding molecule has:
 (a) antibody VH comprising H-CDR1 shown in SEQ ID NO: 392, H-CDR2 shown in SEQ ID NO: 393, and H-CDR3 shown in SEQ ID NO: 394, and antibody VL comprising L-CDR1 shown in SEQ ID NO: 395, L-CDR2 shown in SEQ ID NO: 396, and L-CDR3 shown in SEQ ID NO: 397;
 (b) antibody VH and antibody VL that compete with the antibody VH and the antibody VL described in (a); or
 (c) antibody VH and antibody VL that bind to the same epitope as that for (a).

(33) The ligand-binding molecule according to (32), wherein the ligand-binding molecule is an antibody comprising an antibody heavy chain selected from the sequences represented by SEQ ID NOs: 304 and 305, or an antibody light chain selected from the sequences represented by SEQ ID NOs: 306 to 315 and 322.

(34) The ligand-binding molecule according to (27), wherein the ligand is IL-6R (IL-6 receptor), and wherein the ligand-binding molecule comprises antibody VH and antibody VL, and the ligand-binding molecule has:
  (a) antibody VH comprising H-CDR1 shown in SEQ ID NO: 398, H-CDR2 shown in SEQ ID NO: 399, and H-CDR3 shown in SEQ ID NO: 400, and antibody VL comprising L-CDR1 shown in SEQ ID NO: 401, L-CDR2 shown in SEQ ID NO: 402, and L-CDR3 shown in SEQ ID NO: 403;
  (b) antibody VH and antibody VL that compete with (a); or
  (c) antibody VH and antibody VL that bind to the same epitope as that for (a).

(35) The ligand-binding molecule according to (34), wherein the ligand-binding molecule is an antibody comprising an antibody heavy chain selected from the sequences represented by SEQ ID NOs: 153 to 156, 157 to 159, and 404 to 470, or an antibody light chain selected from the sequences represented by SEQ ID NOs: 471 to 535.

(36) The ligand-binding molecule according to any of (1) to (35), wherein the ligand-binding molecule is an IgG antibody.

(37) The ligand-binding molecule according to any of (1) to (36), which is bound to the ligand.

(38) The ligand-binding molecule according to any of (1) to (36), which is fused with the ligand.

(39) The ligand-binding molecule according to (38), which does not further bind to another ligand in a state where the ligand-binding molecule is fused with the ligand.

(40) The ligand-binding molecule according to (38) or (39), wherein the ligand-binding molecule is fused with the ligand via a linker.

(41) The ligand-binding molecule according to (40), wherein the linker does not comprise a protease cleavage sequence.

(42) The ligand-binding molecule according to any of (38) to (41), wherein the ligand is CXCL10, wherein the ligand-binding molecule comprises an antibody light chain and an antibody heavy chain, and wherein the antibody light chain or the antibody heavy chain is fused with the ligand.

(43) The ligand-binding molecule according to (42), wherein the cleavage site is comprised in the antibody light chain or the antibody heavy chain.

(44) The ligand-binding molecule according to (42) or (43), wherein the ligand is CXCL10, wherein the antibody light chain contained in the ligand-binding molecule is fused with the ligand, and wherein the ligand-binding molecule has:
  (a) an antibody heavy chain comprising H-CDR1 shown in SEQ ID NO: 374, H-CDR2 shown in SEQ ID NO: 375, and H-CDR3 shown in SEQ ID NO: 376, and an antibody light chain comprising L-CDR1 shown in SEQ ID NO: 377, L-CDR2 shown in SEQ ID NO: 378, and L-CDR3 shown in SEQ ID NO: 379; or
  (b) an antibody heavy chain comprising H-CDR1 shown in SEQ ID NO: 380, H-CDR2 shown in SEQ ID NO: 381, and H-CDR3 shown in SEQ ID NO: 382, and an antibody light chain comprising L-CDR1 shown in SEQ ID NO: 383, L-CDR2 shown in SEQ ID NO: 384, and L-CDR3 shown in SEQ ID NO: 385.

(45) The ligand-binding molecule according to any of (42) to (44), wherein the ligand is a CXCL10 variant shown in SEQ ID NO: 370.

(46) The ligand-binding molecule of any one of (42) to (45), wherein the antibody light chain comprised in the ligand-binding molecule is fused with the ligand, and the continuous polypeptide in which CXCL10 and the antibody light chain are fused comprises the sequence shown in SEQ ID NO: 372.

(47) The ligand-binding molecule of any one of (38) to (41), wherein the ligand is PD-1, wherein the ligand-binding molecule comprises an antibody light chain and an antibody heavy chain, and wherein the antibody light chain or the antibody heavy chain is fused with the ligand.

(48) The ligand-binding molecule of (47), wherein the cleavage site is comprised in the antibody light chain or the antibody heavy chain.

(49) The ligand-binding molecule of (47) or (48), wherein the ligand is PD-1, wherein the antibody light chain comprises L-CDR1 of SEQ ID NO: 395, L-CDR2 of SEQ ID NO: 396, and L-CDR3 of SEQ ID NO: 397, and the antibody heavy chain comprises H-CDR1 of SEQ ID NO: 392, H-CDR2 of SEQ ID NO: 393, and H-CDR3 of SEQ ID NO: 394.

(50) The ligand-binding molecule of any one of (47) to (49), wherein the ligand is PD-1 shown in SEQ ID NO: 320.

(51) The ligand-binding molecule of any one of (47) to (50), wherein the ligand is PD-1, wherein the antibody heavy chain comprised in the ligand-binding molecule is fused with the ligand, and wherein the continuous polypeptide in which PD-1 and the antibody heavy chain are fused comprises a sequence selected from the sequences shown in SEQ ID NOs: 323 and 324.

(52) The ligand-binding molecule of any one of (47) to (50), wherein the ligand is PD-1, wherein the antibody light chain comprised in the ligand-binding molecule is fused with the ligand, and wherein the continuous polypeptide in which PD-1 and the antibody light chain are fused comprises a sequence selected from the sequences shown in SEQ ID NOs: 325 to 334.

(53) The ligand-binding molecule of any one of (38) to (41), wherein the ligand is IL-12, wherein the ligand-binding molecule comprises an antibody light chain and an antibody heavy chain, and wherein the antibody light chain or the antibody heavy chain is fused with the ligand.

(54) The ligand-binding molecule of (53), wherein the cleavage site is comprised in the antibody light chain or the antibody heavy chain.

(55) The ligand-binding molecule of (53) or (54), wherein the ligand is IL-12, wherein the antibody light chain comprises L-CDR1 of SEQ ID NO: 389, L-CDR2 of SEQ ID NO: 390, and L-CDR3 of SEQ ID NO: 391, and the antibody heavy chain comprises H-CDR1 of SEQ ID NO: 386, H-CDR2 of SEQ ID NO: 387, and H-CDR3 of SEQ ID NO: 388.

(56) The ligand-binding molecule of any one of (38) to (41), wherein the ligand is IL-6R, wherein the ligand-binding molecule comprises an antibody light chain and an antibody heavy chain, and wherein the antibody light chain or the antibody heavy chain is fused with the ligand.

(57) The ligand-binding molecule of (56), wherein the cleavage site is comprised in the antibody light chain or the antibody heavy chain.

(58) The ligand-binding molecule of (56) or (57), wherein the ligand is IL-6R, wherein the antibody light chain comprises L-CDR1 of SEQ ID NO: 401, L-CDR2 of SEQ ID NO: 402, and L-CDR3 of SEQ ID NO: 403, and the antibody heavy chain comprises H-CDR1 of SEQ ID NO: 398, H-CDR2 of SEQ ID NO: 399, and H-CDR3 of SEQ ID NO: 400.

(59) A complex which is formed of the ligand and the ligand-binding molecule of any one of (1) to (36) which is bound with the ligand.

(60) A fusion protein in which the ligand is fused with the ligand-binding molecule of any one of (1) to (36).

(61) The fusion protein of (60), wherein the ligand-binding molecule, when being in a state of fusion with the ligand, does not further bind to another ligand.

(62) The fusion protein of (60) or (61), wherein the ligand-binding molecule is fused with the ligand via a linker.

(63) The fusion protein of (62), wherein the linker comprises no protease cleavage sequence.

(64) The fusion protein of (62) or (63), wherein the linker consists of a glycine-serine polymer.

(65) The fusion protein of any one of (60) to (64), wherein the ligand is CXCL10, wherein the ligand-binding molecule comprises an antibody light chain and an antibody heavy chain, and wherein the antibody light chain or the antibody heavy chain is fused with the ligand.

(66) The fusion protein of (65), wherein the cleavage site is comprised in the antibody light chain or the antibody heavy chain in the ligand-binding molecule.

(67) The fusion protein of (65) or (66), wherein the ligand is CXCL10, wherein the antibody light chain comprised in the ligand-binding molecule is fused with the ligand, wherein the ligand-binding molecule comprises:
  (a) an antibody heavy chain comprising H-CDR1 of SEQ ID NO: 374, H-CDR2 of SEQ ID NO: 375, and H-CDR3 of SEQ ID NO: 376, and an antibody light chain comprising L-CDR1 of SEQ ID NO: 377, L-CDR2 of SEQ ID NO: 378, and L-CDR3 of SEQ ID NO: 379; or
  (b) an antibody heavy chain comprising H-CDR1 of SEQ ID NO: 380, H-CDR2 of SEQ ID NO: 381, and H-CDR3 of SEQ ID NO: 382, and an antibody light chain comprising L-CDR1 of SEQ ID NO: 383, L-CDR2 of SEQ ID NO: 384, and L-CDR3 of SEQ ID NO: 385.

(68) The fusion protein of any one of (65) to (67), wherein the ligand is a CXCL10 variant shown in SEQ ID NO: 370.

(69) The fusion protein of any one of (65) to (68), wherein the antibody light chain comprised in the ligand-binding molecule is fused with the ligand, and wherein the continuous polypeptide in which CXCL10 and the antibody light chain are fused comprises the sequence shown in SEQ ID NO: 372.

(70) The fusion protein of any one of (60) to (64), wherein the ligand is PD-1, wherein the ligand-binding molecule comprises an antibody light chain and an antibody heavy chain, and wherein the antibody light chain or the antibody heavy chain is fused with the ligand.

(71) The ligand-binding molecule of (70), wherein the cleavage site is comprised in the antibody light chain or the antibody heavy chain.

(72) The fusion protein of (70) or (71), wherein the ligand is PD-1, wherein the antibody light chain comprises L-CDR1 of SEQ ID NO: 395, L-CDR2 of SEQ ID NO: 396, and L-CDR3 of SEQ ID NO: 397, and the antibody heavy chain comprises H-CDR1 of SEQ ID NO: 392, H-CDR2 of SEQ ID NO: 393, and H-CDR3 of SEQ ID NO: 394.

(73) The fusion protein of any one of (70) to (72), wherein the ligand is PD-1 shown in SEQ ID NO: 320.

(74) The fusion protein of any one of (70) to (73), wherein the ligand is PD-1, wherein the antibody heavy chain comprised in the ligand-binding molecule is fused with the ligand, and wherein the continuous polypeptide in which PD-1 and the antibody heavy chain are fused comprises a sequence selected from the sequences shown in SEQ ID NOs: 323 and 324.

(75) The fusion protein of any one of (70) to (73), wherein the ligand is PD-1, wherein the antibody light chain comprised in the ligand-binding molecule is fused with the ligand, and wherein the continuous polypeptide in which PD-1 and the antibody light chain are fused comprises a sequence selected from the sequences shown in SEQ ID NOs: 325 to 334.

(76) The fusion protein of any one of (60) to (64), wherein the ligand is IL-12, wherein the ligand-binding molecule comprises an antibody light chain and an antibody heavy chain, and wherein the antibody light chain or the antibody heavy chain is fused with the ligand.

(77) The fusion protein of (76), wherein the cleavage site is comprised in the antibody light chain or the antibody heavy chain.

(78) The fusion protein of (76) or (77), wherein the ligand is IL-12, wherein the antibody light chain comprises L-CDR1 of SEQ ID NO: 389, L-CDR2 of SEQ ID NO: 390, and L-CDR3 of SEQ ID NO: 391, and the antibody heavy chain comprises H-CDR1 of SEQ ID NO: 386, H-CDR2 of SEQ ID NO: 387, and H-CDR3 of SEQ ID NO: 388.

(79) The fusion protein of any one of (60) to (64), wherein the ligand is IL-6R, wherein the ligand-binding molecule comprises an antibody light chain and an antibody heavy chain, and wherein the antibody light chain or the antibody heavy chain is fused with the ligand.

(80) The fusion protein of (79), wherein the cleavage site is comprised in the antibody light chain or the antibody heavy chain.

(81) The fusion protein of (79) or (80), wherein the ligand is IL-6R, wherein the antibody light chain comprises L-CDR1 of SEQ ID NO: 401, L-CDR2 of SEQ ID NO: 402, and L-CDR3 of SEQ ID NO: 403, and the antibody heavy chain comprises H-CDR1 of SEQ ID NO: 398, H-CDR2 of SEQ ID NO: 399, and H-CDR3 of SEQ ID NO: 400.

(82) A pharmaceutical composition comprising the ligand-binding molecule of any one of (1) to (58).

(83) A pharmaceutical composition comprising the ligand-binding molecule and the ligand as recited in any one of (1) to (37).

(84) A pharmaceutical composition comprising the complex of (59).

(85) A pharmaceutical composition comprising the fusion protein of any one of (60) to (81).

(86) A method for producing the ligand-binding molecule of any one of (1) to (58).
(87) The production method of (86), comprising introducing a protease cleavage sequence into a molecule capable of binding to a ligand.
(88) A method for producing the fusion protein of any one of (60) to (81), comprising fusing a ligand-binding molecule comprising a protease cleavage sequence with a ligand thereof.
(89) A polynucleotide encoding the ligand-binding molecule of any one of (1) to (58).
(90) A vector comprising the polynucleotide of (89).
(91) A host cell comprising the polynucleotide of (89) or the vector of (90).
(92) A method for producing the ligand-binding molecule of any one of (1) to (58), comprising the step of culturing the host cell of (91).
(93) A polynucleotide encoding the fusion protein of any one of (60) to (81).
(94) A vector comprising the polynucleotide of (93).
(95) A host cell comprising the polynucleotide of (93) or the vector of (94).
(96) A method for producing the fusion protein of any one of (60) to (81), comprising the step of culturing the host cell of (95).
(97) A protease substrate comprising a sequence selected from the sequences shown in SEQ ID NOs: 1161-1180, 1392-1411, and the sequences listed in Table 1.
(98) The protease substrate of (97), wherein the protease is matriptase or urokinase.
(99) The protease substrate of (97) or (98), wherein the protease is MT-SP1 or uPA.
(100) A polypeptide comprising one or more sequences selected from the sequences shown in SEQ ID NOs: 1161-1180, 1392-1411, and the sequences listed in Table 1.

The present invention can also specifically include embodiments exemplarily described below.

(B1) A ligand-binding molecule which is capable of binding to a ligand, wherein the molecule is a polypeptide comprising at least one protease cleavage sequence comprising one or more sequences selected from the sequences shown in SEQ ID NOs: 1161-1180 and 1392-1411 and the sequences set forth in Table 1, wherein the binding of the ligand-binding molecule to the ligand in a state where the protease cleavage sequence is cleaved is weaker than the binding of the ligand-binding molecule to the ligand in a state where the protease cleavage sequence is uncleaved.
(B2) The ligand-binding molecule of (B1), wherein the ligand is released from the ligand-binding molecule in a state where the protease cleavage sequence is cleaved.
(B3) The ligand-binding molecule of (B1) or (B2), wherein the protease is a target tissue-specific protease.
(B4) The ligand-binding molecule of (B3), wherein the target tissue is a cancer tissue, and the target tissue-specific protease is a cancer tissue-specific protease.
(B5) The ligand-binding molecule of (B3), wherein the target tissue is an inflammatory tissue, and the target tissue-specific protease is an inflammatory tissue-specific protease.
(B6) The ligand-binding molecule of any one of (B1) to (B5), wherein the protease is at least one protease selected from matriptase, urokinase (uPA), and metalloprotease.
(B7) The ligand-binding molecule of any one of (B1) to (B6), wherein a first flexible linker is further added to one end of the protease cleavage sequence.
(B8) The ligand-binding molecule of (B7), wherein the first flexible linker consists of a glycine-serine polymer.
(B9) The ligand-binding molecule of (B7) or (B8), wherein a second flexible linker is further added to the other end of the protease cleavage sequence.
(B10) The ligand-binding molecule of (B9), wherein the second flexible linker consists of a glycine-serine polymer.
(B11) The ligand-binding molecule of any one of (B1) to (B10), which comprises an antibody VH, an antibody VL, and an antibody constant region.
(B12) The ligand-binding molecule of (B11), wherein the protease cleavage sequence, the protease cleavage sequence and the first flexible linker, or the protease cleavage sequence, the first flexible linker, and the second flexible linker, are located within the antibody constant region.
(B13) The ligand-binding molecule of (B12), wherein the protease cleavage sequence, the protease cleavage sequence and the first flexible linker, or the protease cleavage sequence, the first flexible linker, and the second flexible linker, are introduced into any position within the sequence from amino acid 118 in the antibody heavy chain constant region (EU numbering) to amino acid 140 in the antibody heavy chain constant region (EU numbering).
(B14) The ligand-binding molecule of (B12), wherein the protease cleavage sequence, the protease cleavage sequence and the first flexible linker, or the protease cleavage sequence, the first flexible linker, and the second flexible linker, are introduced into any position within the sequence from amino acid 108 in the antibody light chain constant region (EU numbering) (108 in Kabat numbering) to amino acid 131 in the antibody light chain constant region (EU numbering) (131 in Kabat numbering).
(B15) The ligand-binding molecule of (B11), wherein the protease cleavage sequence, the protease cleavage sequence and the first flexible linker, or the protease cleavage sequence, the first flexible linker, and the second flexible linker, are located within the antibody VH or the antibody VL.
(B16) The ligand-binding molecule of (B15), wherein the protease cleavage sequence, the protease cleavage sequence and the first flexible linker, or the protease cleavage sequence, the first flexible linker, and the second flexible linker, are introduced into any position within a sequence selected from the group consisting of amino acid 7 (Kabat numbering) to amino acid 16 (Kabat numbering), amino acid 40 (Kabat numbering) to amino acid 47 (Kabat numbering), amino acid 55 (Kabat numbering) to amino acid 69 (Kabat numbering), amino acid 73 (Kabat numbering) to amino acid 79 (Kabat numbering), amino acid 83 (Kabat numbering) to amino acid 89 (Kabat numbering), amino acid 95 (Kabat numbering) to amino acid 99 (Kabat numbering), and amino acid 101 (Kabat numbering) to amino acid 113 (Kabat numbering) in the antibody VH.
(B17) The ligand-binding molecule of (B15), wherein the protease cleavage sequence, the protease cleavage sequence and the first flexible linker, or the protease cleavage sequence, the first flexible linker, and the second flexible linker, are introduced into any position within a sequence selected from the group consisting of amino acid 7 (Kabat numbering) to amino acid 19 (Kabat numbering), amino acid 39 (Kabat numbering) to amino acid 46 (Kabat numbering), amino acid 49 (Kabat numbering) to amino acid 62 (Kabat numbering), and amino acid 96 (Kabat numbering) to amino acid 107 (Kabat numbering) in the antibody VL.
(B18) The ligand-binding molecule of (B11), wherein the protease cleavage sequence, the protease cleavage sequence and the first flexible linker, or the protease cleavage sequence, the first flexible linker, and the second flexible linker, are located near the boundary between the antibody constant region and the antibody VH, or/and the boundary between the antibody constant region and the antibody VL.
(B19) The ligand-binding molecule of (B18), wherein the protease cleavage sequence, the protease cleavage sequence and the first flexible linker, or the protease cleavage sequence, the first flexible linker, and the second flexible linker, are introduced into any position within the sequence from amino acid 109 in the antibody VH (Kabat numbering) to amino acid 122 in the antibody heavy chain constant region (EU numbering).
(B20) The ligand-binding molecule of (B18), wherein the protease cleavage sequence, the protease cleavage sequence and the first flexible linker, or the protease cleavage sequence, the first flexible linker, and the second flexible linker, are introduced into any position within the sequence from amino acid 104 in the antibody VL (Kabat numbering) to amino acid 113 in the antibody light chain constant region (EU numbering) (position 113 in Kabat numbering).
(B21) The ligand-binding molecule of any one of (B11) to (B20), wherein the antibody VL and the antibody VH in the ligand-binding molecule are associated with each other, and the association is eliminated by cleavage of the protease cleavage sequence with the protease.
(B22) The ligand-binding molecule of any one of (B1) to (B21), wherein the ligand is a biologically active molecule, wherein the ligand-binding molecule inhibits the biological activity of the ligand by binding to the ligand.
(B23) The ligand-binding molecule of any one of (B1) to (B22), wherein the ligand is a cytokine or a chemokine.
(B24) The ligand-binding molecule of any one of (B1) to (B22), wherein the ligand is selected from an interleukin, interferon, hematopoietic factor, TNF superfamily, chemokine, cell growth factor, and TGF-β family.
(B25) The ligand-binding molecule of any one of (B1) to (B22), wherein the ligand is CXCL10, IL-12, PD-1, IL-6R, or IL-1Ra.
(B26) The ligand-binding molecule of (B25), wherein the ligand is CXCL10, wherein the ligand-binding molecule comprises an antibody VH and an antibody VL, wherein the ligand-binding molecule comprises:
 (a) an antibody VH comprising H-CDR1 of SEQ ID NO: 374, H-CDR2 of SEQ ID NO: 375, and H-CDR3 of SEQ ID NO: 376, and an antibody VL comprising L-CDR1 of SEQ ID NO: 377, L-CDR2 of SEQ ID NO: 378, and L-CDR3 of SEQ ID NO: 379; or
 (b) an antibody VH comprising H-CDR1 of SEQ ID NO: 380, H-CDR2 of SEQ ID NO: 381, and H-CDR3 of SEQ ID NO: 382, and an antibody VL comprising L-CDR1 of SEQ ID NO: 383, L-CDR2 of SEQ ID NO: 384, and L-CDR3 of SEQ ID NO: 385; or
 (c) an antibody VH and an antibody VL which compete with (a) or (b); or
 (d) an antibody VH and an antibody VL which bind to the same epitope as (a) or (b).
(B27) The ligand-binding molecule of (B26), which is an antibody comprising an antibody heavy chain selected from the sequences shown in SEQ ID NOs: 4-14, 23-27, 33, 59, 60, and 346-367, or an antibody light chain selected from the sequences shown in SEQ ID NOs: 15-22, 1146-1160, 1282-1380, and 1386-1389.
(B28) The ligand-binding molecule of (B25), wherein the ligand is IL-12, wherein the ligand-binding molecule comprises an antibody VH and an antibody VL, wherein the ligand-binding molecule comprises:
 (a) an antibody VH comprising H-CDR1 of SEQ ID NO: 386, H-CDR2 of SEQ ID NO: 387, and H-CDR3 of SEQ ID NO: 388, and an antibody VL comprising L-CDR1 of SEQ ID NO: 389, L-CDR2 of SEQ ID NO: 390, and L-CDR3 of SEQ ID NO: 391; or
 (b) an antibody VH and an antibody VL which compete with (a); or
 (c) an antibody VH and an antibody VL which bind to the same epitope as (a).
(B29) The ligand-binding molecule of (B28), which is an antibody comprising an antibody heavy chain shown in SEQ ID NO: 146.
(B30) The ligand-binding molecule of (B25), wherein the ligand is PD-1, wherein the ligand-binding molecule comprises an antibody VH and an antibody VL, wherein the ligand-binding molecule comprises:
 (a) an antibody VH comprising H-CDR1 of SEQ ID NO: 392, H-CDR2 of SEQ ID NO: 393, and H-CDR3 of SEQ ID NO: 394, and an antibody VL comprising L-CDR1 of SEQ ID NO: 395, L-CDR2 of SEQ ID NO: 396, and L-CDR3 of SEQ ID NO: 397; or
 (b) an antibody VH and an antibody VL which compete with (a); or
 (c) an antibody VH and an antibody VL which bind to the same epitope as (a).
(B31) The ligand-binding molecule of (B30), which is an antibody comprising an antibody heavy chain selected from the sequences shown in SEQ ID NOs: 304 and 305, or an antibody light chain selected from the sequences shown in SEQ ID NOs: 306-315 and 322.
(B32) The ligand-binding molecule of (B25), wherein the ligand is IL-6R (IL-6 receptor), wherein the ligand-binding molecule comprises an antibody VH and an antibody VL, wherein the ligand-binding molecule comprises:
 (a) an antibody VH comprising H-CDR1 of SEQ ID NO: 398, H-CDR2 of SEQ ID NO: 399, and H-CDR3 of SEQ ID NO: 400, and an antibody VL comprising L-CDR1 of SEQ ID NO: 401, L-CDR2 of SEQ ID NO: 402, and L-CDR3 of SEQ ID NO: 403; or
 (b) an antibody VH and an antibody VL which compete with (a); or
 (c) an antibody VH and an antibody VL which bind to the same epitope as (a).
(B33) The ligand-binding molecule of (B32), which is an antibody comprising an antibody heavy chain selected from the sequences shown in SEQ ID NOs: 153-156, 157-159, and 404-470, or an antibody light chain selected from the sequences shown in SEQ ID NOs: 471-535.

(B34) The ligand-binding molecule of any one of (B1) to (B33), which is an IgG antibody.
(B35) The ligand-binding molecule of any one of (B1) to (B34), which is bound with the ligand.
(B36) The ligand-binding molecule of any one of (B1) to (B34), which is fused with the ligand.
(B37) The ligand-binding molecule of (B36), which, when being in a state of fusion with the ligand, does not further bind to another ligand.
(B38) The ligand-binding molecule of (B36) or (B37), which is fused with the ligand via a linker.
(B39) The ligand-binding molecule of (B38), wherein the linker comprises no protease cleavage sequence.
(B40) The ligand-binding molecule of any one of (B36) to (B39), wherein the ligand is CXCL10, wherein the ligand-binding molecule comprises an antibody light chain and an antibody heavy chain, and wherein the antibody light chain or the antibody heavy chain is fused with the ligand.
(B41) The ligand-binding molecule of (B40), wherein the protease cleavage sequence is comprised in the antibody light chain or the antibody heavy chain.
(B42) The ligand-binding molecule of (B40) or (B41), wherein the ligand is CXCL10, wherein the antibody light chain comprised in the ligand-binding molecule is fused with the ligand, and wherein the ligand-binding molecule comprises:
  (a) an antibody heavy chain comprising H-CDR1 of SEQ ID NO: 374, H-CDR2 of SEQ ID NO: 375, and H-CDR3 of SEQ ID NO: 376, and an antibody light chain comprising L-CDR1 of SEQ ID NO: 377, L-CDR2 of SEQ ID NO: 378, and L-CDR3 of SEQ ID NO: 379; or
  (b) an antibody heavy chain comprising H-CDR1 of SEQ ID NO: 380, H-CDR2 of SEQ ID NO: 381, and H-CDR3 of SEQ ID NO: 382, and an antibody light chain comprising L-CDR1 of SEQ ID NO: 383, L-CDR2 of SEQ ID NO: 384, and L-CDR3 of SEQ ID NO: 385.
(B43) The ligand-binding molecule of any one of (B40) to (B42), wherein the ligand is a CXCL10 variant shown in SEQ ID NO: 370.
(B44) The ligand-binding molecule of any one of (B40) to (B43), wherein the antibody light chain comprised in the ligand-binding molecule is fused with the ligand, and wherein the continuous polypeptide in which CXCL10 and the antibody light chain are fused comprises the sequence shown in SEQ ID NO: 372.
(B45) The ligand-binding molecule of any one of (B36) to (B39), wherein the ligand is PD-1, wherein the ligand-binding molecule comprises an antibody light chain and an antibody heavy chain, and wherein the antibody light chain or the antibody heavy chain is fused with the ligand.
(B46) The ligand-binding molecule of (B45), wherein the protease cleavage sequence is comprised in the antibody light chain or the antibody heavy chain.
(B47) The ligand-binding molecule of (B45) or (B46), wherein the ligand is PD-1, wherein the antibody light chain comprises L-CDR1 of SEQ ID NO: 395, L-CDR2 of SEQ ID NO: 396, and L-CDR3 of SEQ ID NO: 397, and the antibody heavy chain comprises H-CDR1 of SEQ ID NO: 392, H-CDR2 of SEQ ID NO: 393, and H-CDR3 of SEQ ID NO: 394.
(B48) The ligand-binding molecule of any one of (B45) to (B47), wherein the ligand is PD-1 shown in SEQ ID NO: 320.
(B49) The ligand-binding molecule of any one of (B45) to (B48), wherein the ligand is PD-1, wherein the antibody heavy chain comprised in the ligand-binding molecule is fused with the ligand, and wherein the continuous polypeptide in which PD-1 and the antibody heavy chain are fused comprises a sequence selected from the sequences shown in SEQ ID NOs: 323 and 324.
(B50) The ligand-binding molecule of any one of (B45) to (B48), wherein the ligand is PD-1, wherein the antibody light chain comprised in the ligand-binding molecule is fused with the ligand, and wherein the continuous polypeptide in which PD-1 and the antibody light chain are fused comprises a sequence selected from the sequences shown in SEQ ID NOs: 325 to 334.
(B51) The ligand-binding molecule of any one of (B36) to (B39), wherein the ligand is IL-12, wherein the ligand-binding molecule comprises an antibody light chain and an antibody heavy chain, and wherein the antibody light chain or the antibody heavy chain is fused with the ligand.
(B52) The ligand-binding molecule of (B51), wherein the protease cleavage sequence is comprised in the antibody light chain or the antibody heavy chain.
(B53) The ligand-binding molecule of (B51) or (B52), wherein the ligand is IL-12, wherein the antibody light chain comprises L-CDR1 of SEQ ID NO: 389, L-CDR2 of SEQ ID NO: 390, and L-CDR3 of SEQ ID NO: 391, and the antibody heavy chain comprises H-CDR1 of SEQ ID NO: 386, H-CDR2 of SEQ ID NO: 387, and H-CDR3 of SEQ ID NO: 388.
(B54) The ligand-binding molecule of any one of (B36) to (B39), wherein the ligand is IL-6R, wherein the ligand-binding molecule comprises an antibody light chain and an antibody heavy chain, and wherein the antibody light chain or the antibody heavy chain is fused with the ligand.
(B55) The ligand-binding molecule of (B54), wherein the protease cleavage sequence is comprised in the antibody light chain or the antibody heavy chain.
(B56) The ligand-binding molecule of (B54) or (B55), wherein the ligand is IL-6R, wherein the antibody light chain comprises L-CDR1 of SEQ ID NO: 401, L-CDR2 of SEQ ID NO: 402, and L-CDR3 of SEQ ID NO: 403, and the antibody heavy chain comprises H-CDR1 of SEQ ID NO: 398, H-CDR2 of SEQ ID NO: 399, and H-CDR3 of SEQ ID NO: 400.
(B57) A complex which is formed of the ligand and the ligand-binding molecule of any one of (B1) to (B34) which is bound with the ligand.
(B58) A fusion protein in which the ligand is fused with the ligand-binding molecule of any one of (B1) to (B34).
(B59) The fusion protein of (B58), wherein the ligand-binding molecule, when being in a state of fusion with the ligand, does not further bind to another ligand.
(B60) The fusion protein of (B58) or (B59), wherein the ligand-binding molecule is fused with the ligand via a linker.
(B61) The fusion protein of (B60), wherein the linker comprises no protease cleavage sequence.
(B62) The fusion protein of (B60) or (B61), wherein the linker consists of a glycine-serine polymer.
(B63) The fusion protein of any one of (B58) to (B62), wherein the ligand is CXCL10, wherein the ligand-binding molecule comprises an antibody light chain and an antibody heavy chain, and wherein the antibody light chain or the antibody heavy chain is fused with the ligand.
(B64) The fusion protein of (B63), wherein the protease cleavage sequence is comprised in the antibody light chain or the antibody heavy chain in the ligand-binding molecule.
(B65) The fusion protein of (B63) or (B64), wherein the ligand is CXCL10, wherein the antibody light chain comprised in the ligand-binding molecule is fused with the ligand, and wherein the ligand-binding molecule comprises:
  (a) an antibody heavy chain comprising H-CDR1 of SEQ ID NO: 374, H-CDR2 of SEQ ID NO: 375, and H-CDR3 of SEQ ID NO: 376, and an antibody light chain comprising L-CDR1 of SEQ ID NO: 377, L-CDR2 of SEQ ID NO: 378, and L-CDR3 of SEQ ID NO: 379; or
  (b) an antibody heavy chain comprising H-CDR1 of SEQ ID NO: 380, H-CDR2 of SEQ ID NO: 381, and H-CDR3 of SEQ ID NO: 382, and an antibody light chain comprising L-CDR1 of SEQ ID NO: 383, L-CDR2 of SEQ ID NO: 384, and L-CDR3 of SEQ ID NO: 385.
(B66) The fusion protein of any one of (B63) to (B65), wherein the ligand is a CXCL10 variant shown in SEQ ID NO: 370.
(B67) The fusion protein of any one of (B63) to (B66), wherein the antibody light chain comprised in the ligand-binding molecule is fused with the ligand, and wherein the continuous polypeptide in which CXCL10 and the antibody light chain are fused comprises the sequence shown in SEQ ID NO: 372.
(B68) The fusion protein of any one of (B58) to (B62), wherein the ligand is PD-1, wherein the ligand-binding molecule comprises an antibody light chain and an antibody heavy chain, and wherein the antibody light chain or the antibody heavy chain is fused with the ligand.
(B69) The ligand-binding molecule of (B68), wherein the protease cleavage sequence is comprised in the antibody light chain or the antibody heavy chain.
(B70) The fusion protein of (B68) or (B69), wherein the ligand is PD-1, wherein the antibody light chain comprises L-CDR1 of SEQ ID NO: 395, L-CDR2 of SEQ ID NO: 396, and L-CDR3 of SEQ ID NO: 397, and the antibody heavy chain comprises H-CDR1 of SEQ ID NO: 392, H-CDR2 of SEQ ID NO: 393, and H-CDR3 of SEQ ID NO: 394.
(B71) The fusion protein of any one of (B68) to (B70), wherein the ligand is PD-1 shown in SEQ ID NO: 320.
(B72) The fusion protein of any one of (B68) to (B71), wherein the ligand is PD-1, wherein the antibody heavy chain comprised in the ligand-binding molecule is fused with the ligand, and wherein the continuous polypeptide in which PD-1 and the antibody heavy chain are fused comprises a sequence selected from the sequences shown in SEQ ID NOs: 323 and 324.
(B73) The fusion protein of any one of (B68) to (B71), wherein the ligand is PD-1, wherein the antibody light chain comprised in the ligand-binding molecule is fused with the ligand, and wherein the continuous polypeptide in which PD-1 and the antibody light chain are fused comprises a sequence selected from the sequences shown in SEQ ID NOs: 325 to 334.
(B74) The fusion protein of any one of (B58) to (B62), wherein the ligand is IL-12, wherein the ligand-binding molecule comprises an antibody light chain and an antibody heavy chain, and wherein the antibody light chain or the antibody heavy chain is fused with the ligand.
(B75) The fusion protein of (B74), wherein the protease cleavage sequence is comprised in the antibody light chain or the antibody heavy chain.
(B76) The fusion protein of (B74) or (B75), wherein the ligand is IL-12, wherein the antibody light chain comprises L-CDR1 of SEQ ID NO: 389, L-CDR2 of SEQ ID NO: 390, and L-CDR3 of SEQ ID NO: 391, and the antibody heavy chain comprises H-CDR1 of SEQ ID NO: 386, H-CDR2 of SEQ ID NO: 387, and H-CDR3 of SEQ ID NO: 388.
(B78) The fusion protein of any one of (B58) to (B62), wherein the ligand is IL-6R, wherein the ligand-binding molecule comprises an antibody light chain and an antibody heavy chain, and wherein the antibody light chain or the antibody heavy chain is fused with the ligand.
(B78) The fusion protein of (B77), wherein the protease cleavage sequence is comprised in the antibody light chain or the antibody heavy chain.
(B79) The fusion protein of (B77) or (B78), wherein the ligand is IL-6R, wherein the antibody light chain comprises L-CDR1 of SEQ ID NO: 401, L-CDR2 of SEQ ID NO: 402, and L-CDR3 of SEQ ID NO: 403, and the antibody heavy chain comprises H-CDR1 of SEQ ID NO: 398, H-CDR2 of SEQ ID NO: 399, and H-CDR3 of SEQ ID NO: 400.
(B80) A pharmaceutical composition comprising the ligand-binding molecule of any one of (B1) to (B56).
(B81) A pharmaceutical composition comprising the ligand-binding molecule and the ligand as recited in any one of (B1) to (B35).
(B82) A pharmaceutical composition comprising the complex of (B57).
(B83) A pharmaceutical composition comprising the fusion protein of any one of (B58) to (B79).
(B84) A method for producing the ligand-binding molecule of any one of (B1) to (B56).
(B85) The production method of (B84), comprising introducing a protease cleavage sequence into a molecule capable of binding to a ligand.
(B86) A method for producing the fusion protein of any one of (B58) to (B79), comprising fusing a ligand-binding molecule comprising a protease cleavage sequence with a ligand thereof.
(B87) A polynucleotide encoding the ligand-binding molecule of any one of (B1) to (B56).
(B88) A vector comprising the polynucleotide of (B87).
(B89) A host cell comprising the polynucleotide of (B87) or the vector of (B88).
(B90) A method for producing the ligand-binding molecule of any one of (B1) to (B56), comprising the step of culturing the host cell of (B89).
(B92) A polynucleotide encoding the fusion protein of any one of (B58) to (B79).
(B92) A vector comprising the polynucleotide of (B91).
(B93) A host cell comprising the polynucleotide of (B91) or the vector of (B92).
(B94) A method for producing the fusion protein of any one of (B58) to (B79), comprising the step of culturing the host cell of (B93).

BRIEF DESCRIPTION OF DRAWINGS

FIG. 1A is a diagram showing the insertion of protease cleavage sequence into a molecule formed by fusing ligand and anti-ligand antibody via linker. FIG. 1B is a diagram showing the molecule in FIG. 1A before and after protease cleavage of the protease cleavage sequence.

FIG. 2A is a diagram showing the insertion of protease cleavage sequence into an anti-ligand antibody via linker. FIG. 2B is a diagram showing the molecule in FIG. 2A before and after protease cleavage of the protease cleavage sequence.

FIG. 5A is a diagram showing models of antibody molecules prepared by inserting a protease cleavage sequence near the boundary between the antibody variable region and constant region of MabCXCL10.

FIG. 5B is a diagram showing the name of each prepared heavy chain variant, the insertion position of the protease cleavage sequence, and the inserted amino acid sequence. The insertion site is indicated by [insert].

FIG. 5C is a diagram showing the name of each prepared light chain variant, the insertion position of the protease cleavage sequence, and the inserted amino acid sequence. The insertion site is indicated by [insert].

FIG. 8 is a diagram showing the name of each heavy chain variant prepared by inserting a protease cleavage sequence and a flexible linker sequence near the boundary between the variable region and constant region of MabCXCL10, the insertion position of the protease cleavage sequence and the flexible linker sequence, and the inserted amino acid sequence. The insertion site is indicated by [insert].

FIG. 11A is a diagram showing results of evaluating whether CXCL10 would be released by the protease (MT-SP1) treatment of a complex of MabCXCL10a and CXCL10.

FIG. 12 is a diagram showing the name of each heavy chain prepared by substituting a portion of an amino acid sequence near the boundary between the variable region and constant region of MabCXCL10 with a protease cleavage sequence and a flexible linker sequence, the amino acid insertion and alteration sites, the inserted sequence, and the amino acid sequence after the insertion and the alteration. The insertion site is indicated by [insert]. The amino acid residues indicated by strike-through in the column "Insertion position and alteration position" were removed, i.e., substituted by the most C-terminal amino acid of the inserted sequence, at the time of insertion of the inserted sequence.

FIG. 19A is a diagram showing the protease cleavage of an antibody.

FIG. 19B is a diagram showing the protease cleavage of an antibody.

Figure 1:
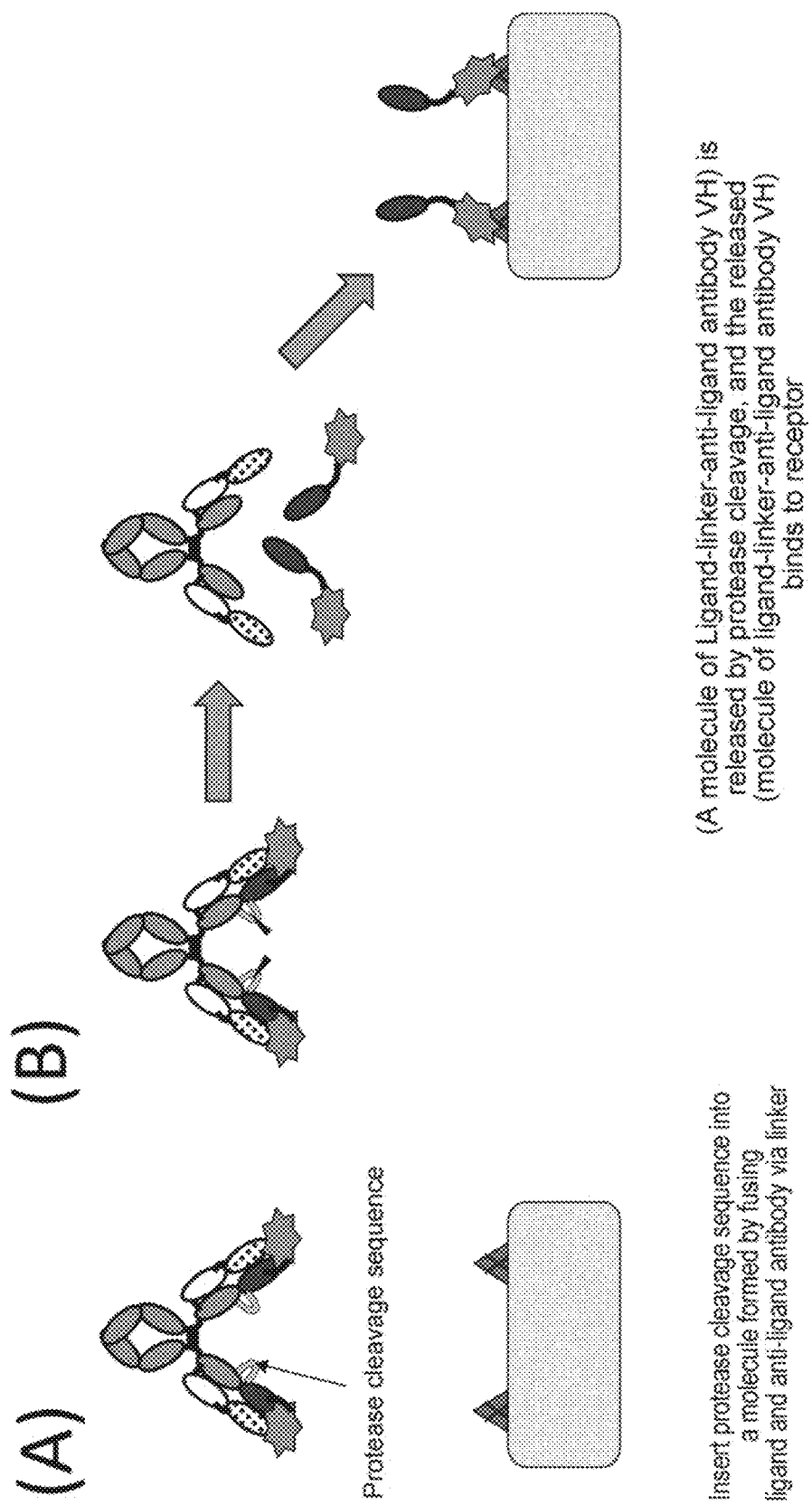
FIGS. 1A and 1B are diagrams showing a fusion protein composed of an IgG antibody and a ligand comprising a ligand-linker-anti-ligand antibody VH molecule which is specifically released in a target tissue, and one mode of activation thereof. The ligand and the anti-ligand antibody are connected via the linker.
Figure 2:
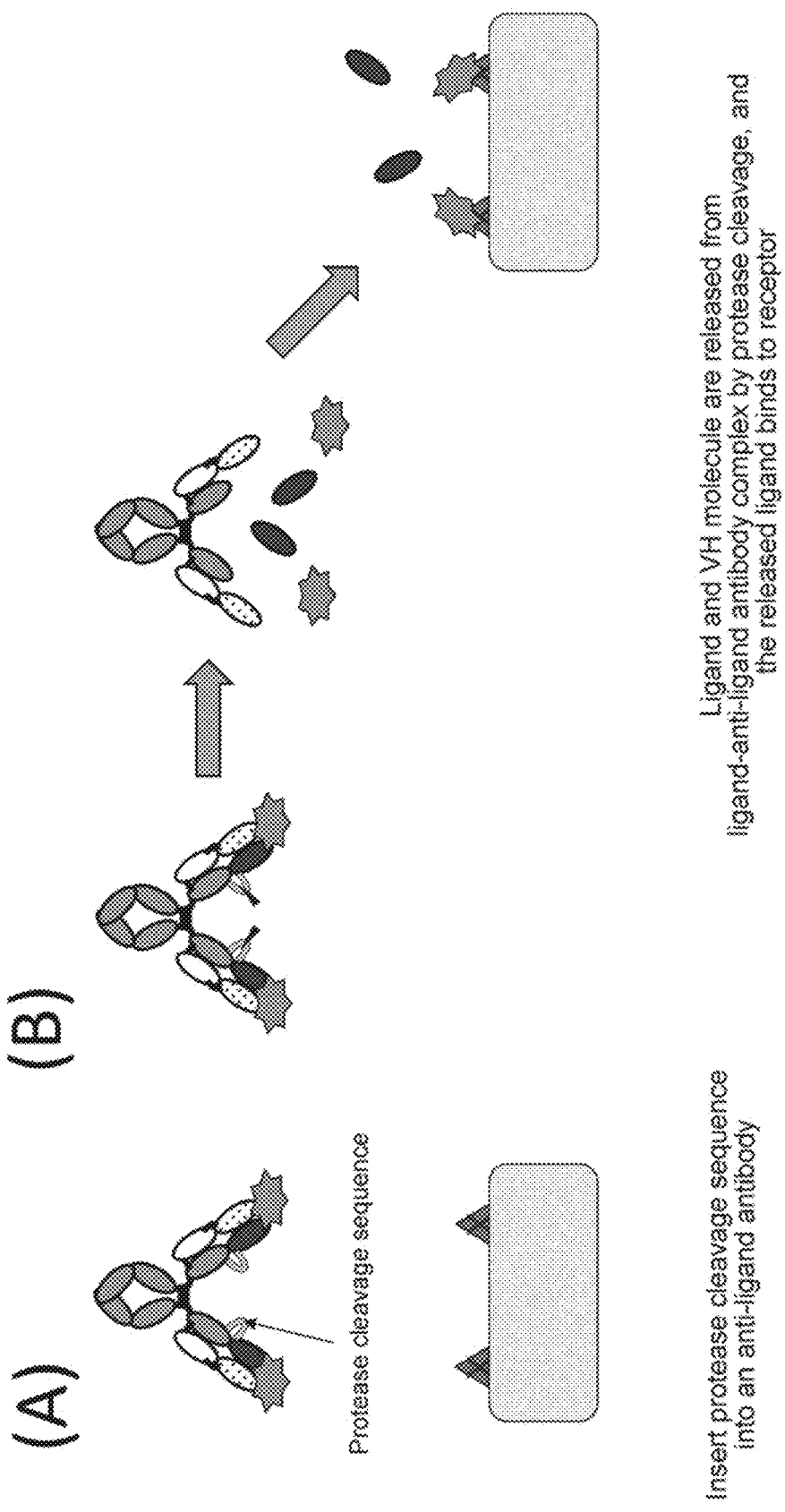
FIGS. 2A and 2B are diagrams showing an IgG antibody that releases a ligand specifically in a target tissue, and one mode of activation thereof. An anti-ligand antibody with a protease cleavage sequence inserted near the boundary between VH and CH1 is mixed with the ligand and administered to an individual.

FIG. 22C is a diagram showing results of cleaving MRA antibody variants by protease.

FIG. 22D is a diagram showing results of cleaving MRA antibody variants by protease.

FIG. 22E is a diagram showing results of cleaving MRA antibody variants by protease.

FIG. 22F is a diagram showing results of cleaving MRA antibody variants by protease.

FIG. 22G is a diagram showing results of cleaving MRA antibody variants by protease.

FIG. 22H is a diagram showing results of cleaving MRA antibody variants by protease.

FIG. 22I is a diagram showing results of cleaving MRA antibody variants by protease.

FIG. 23A is a diagram showing results of cleaving MRA antibody variants by protease.

FIG. 23B is a diagram showing results of cleaving MRA antibody variants by protease.

FIG. 23C is a diagram showing results of cleaving MRA antibody variants by protease.

FIG. 24A is a diagram showing results of cleaving MRA antibody variants by protease.

FIG. 24B is a diagram showing results of cleaving MRA antibody variants by protease.

FIG. 24C is a diagram showing results of cleaving MRA antibody variants by protease.

FIG. 24D is a diagram showing results of cleaving MRA antibody variants by protease.

FIG. 24E is a diagram showing results of cleaving MRA antibody variants by protease.

FIG. 25A is a diagram showing results of cleaving MRA antibody variants by protease.

FIG. 25B is a diagram showing results of cleaving MRA antibody variants by protease.

FIG. 26 is a diagram showing the comparison of real-time graphs showing the 5C4-bio binding of PD1 in samples for binding evaluation containing a protease-treated antibody or a protease-untreated antibody and the PD1. The heavy black lines depict the samples for binding evaluation containing the protease-treated antibody, and the thin gray lines depict the samples for binding evaluation containing the protease-untreated antibody. The X-axis depicts measurement time (sec), and the start of measurement was defined as 0 seconds. The Y-axis depicts binding. The name of each graph represents the antibody contained in the sample for evaluation. The graph "None (only antigen)" means that only the antigen was used as the sample for evaluation and was not mixed with an antibody.

FIG. 27 shows electrophoresis results of protease-treated antibodies and protease-untreated antibodies. Protease (+) lanes depict the protease-treated antibodies, and protease (−) lanes depict the protease-untreated antibodies.

FIG. 28 is a diagram showing the comparison of real-time graphs showing the PD1 binding of protease-treated antibodies and protease-untreated antibodies. The heavy black lines depict the protease-treated antibodies, and the thin gray lines depict the protease-untreated antibodies. The X-axis depicts measurement time (sec), and the start of measurement was defined as 0 seconds. The Y-axis depicts binding. The name of each graph represents the antibody used. The graph "None" means that only a PBS buffer was used and an antibody was not used.

FIG. 29 is a diagram showing the comparison of real-time graphs showing the 5C4-bio binding of released PD-1 present in samples treated with protease in the presence of PD-1 and samples untreated with protease in the presence of PD-1. The heavy black lines depict the protease-treated samples, and the thin gray lines depict the protease-untreated samples. The X-axis depicts measurement time (sec), and the start of measurement was defined as 0 seconds. The Y-axis depicts binding. The name of each graph represents the antibody contained in the sample. The graph "Antigen and protease" means that the sample contained only PD-1 and did not contain an antibody.

FIG. 30 is a diagram showing the comparison of real-time graphs showing the 5C4-bio binding of released PD-1 present in solutions containing protease-treated fusion protein and protease-untreated protein. The heavy black lines depict the protease-treated samples, and the thin gray lines depict the protease-untreated samples. The X-axis depicts measurement time (sec), and the start of measurement was defined as 0 seconds. The Y-axis depicts binding. The name of each graph represents the antibody in the fusion protein. The graph "None (only antigen)" means that only the antigen PD-1 was used as the sample for evaluation and a fusion protein was not used. The graph "5C4H-GIT4/5C4L-KT0" means that only the 5C4H-GIT4/5C4L-KT0 antibody was used and a fusion protein was not used.

FIG. 31 shows electrophoresis results of antibody-PD-1 fusion proteins treated with protease. Protease (+) lanes depict the protease-treated fusion proteins, and protease (−) lanes depict protease-untreated fusion proteins.

FIG. 32 shows evaluation of in vivo cleavage efficiency of antibody molecules with an inserted protease cleavage sequence which were administered to mice.

DESCRIPTION OF EMBODIMENTS

The polypeptide according to the present invention usually refers to a peptide having a length of about 4 amino acids or longer, and a protein. Also, the polypeptide according to the present invention is usually a polypeptide consisting of an artificially designed sequence, but is not particularly limited thereto and includes, for example, a polypeptide derived from an organism. Further, the polypeptide according to the present invention may be any of a natural polypeptide, a synthetic polypeptide, a recombinant polypeptide, and the like. Furthermore, fragments of these polypeptides are also included in the polypeptide of the present invention.

In the present specification, each amino acid is indicated by one-letter code or three-letter code, or both, as represented by, for example, Ala/A, Leu/L, Arg/R, Lys/K, Asn/N, Met/M, Asp/D, Phe/F, Cys/C, Pro/P, Gln/Q, Ser/S, Glu/E, Thr/T, Gly/G, Trp/W, His/H, Tyr/Y, Ile/I, or Val/V.

For the alteration of an amino acid in the amino acid sequence of a polypeptide, a method known in the art such as site-directed mutagenesis (Kunkel et al. (Proc. Natl. Acad. Sci. USA (1985) 82, 488-492)) or overlap extension PCR can be appropriately adopted. A plurality of methods known in the art can also be adopted as alteration methods for substituting an amino acid by an amino acid other than a natural amino acid (Annu. Rev. Biophys. Biomol. Struct. (2006) 35, 225-249; and Proc. Natl. Acad. Sci. U.S.A. (2003) 100 (11), 6353-6357). For example, a tRNA-containing cell-free translation system (Clover Direct (Protein Express)) in which a non-natural amino acid is bound to an amber suppressor tRNA complementary to UAG codon (amber codon), which is a stop codon, is also preferably used.

In the present specification, the term "and/or" used to represent amino acid alteration sites is meant to include every combination in which "and" and "or" are appropriately combined. Specifically, for example, the phrase "amino acids at positions 37, 45, and/or 47 are substituted" includes the following variations of amino acid alteration:
(a) position 37, (b) position 45, (c) position 47, (d) positions 37 and 45, (e) positions 37 and 47, (f) positions 45 and 47, and (g) positions 37, 45, and 47.

In the present specification, expression in which the one-letter codes or three-letter-codes of amino acids before and after alteration are written prior to and subsequent to a number representing a particular position can be appropriately used for representing amino acid alteration. For example, the alteration F37V or Phe37Val used for substituting an amino acid contained in an antibody variable region represents the substitution of Phe at position 37 defined by the Kabat numbering with Val. Specifically, the number represents an amino acid position defined by the Kabat numbering; the one-letter code or three-letter code of the amino acid written prior to the number represents the amino acid before the substitution; and the one-letter code or three-letter code of the amino acid subsequent to the number represents the amino acid after the substitution. Likewise, the alteration P238A or Pro238Ala used for substituting an amino acid in an Fc region contained in an antibody constant region represents the substitution of Pro at position 238 defined by the EU numbering with Ala. Specifically, the number represents an amino acid position defined by the EU numbering; the one-letter code or three-letter code of the amino acid written prior to the number represents the amino acid before the substitution; and the one-letter code or three-letter code of the amino acid subsequent to the number represents the amino acid after the substitution.

The present invention relates to a ligand-binding molecule having a cleavage site and the binding of which to the ligand is attenuated in a state where the cleavage site is cleaved. The ligand-binding molecule of the present invention is a polypeptide and refers to a molecule capable of binding to a ligand.

The ligand-binding molecule of the present invention is a molecule capable of binding to a ligand, particularly, a molecule capable of binding to a ligand in an uncleaved state. In this context, the "binding" usually refers to binding through interaction based mainly on a noncovalent bond such as electrostatic force, van der Waals' force, or a hydrogen bond. Preferred examples of the ligand binding form of the ligand-binding molecule of the present invention include, but are not limited to, antigen-antibody reaction through which an antigen binding region, an antigen binding molecule, an antibody, an antibody fragment, or the like binds to the antigen.

The phrase "capable of binding to a ligand" means that the ligand-binding molecule is capable of binding to the ligand even if the ligand-binding molecule and the ligand are separate molecules, and does not mean that the ligand-binding molecule and the ligand are connected through a covalent bond. For example, the fact that the ligand and the ligand-binding molecule are covalently bound via a linker is not referred to as "capable of binding to a ligand". Also, the phrase "ligand binding is attenuated" means that the capability of binding (binding capacity) described above is attenuated. For example, when the ligand and the ligand-binding molecule are covalently bound via a linker, cleavage of the linker does not mean attenuation of the ligand binding. In the present invention, the ligand-binding molecule may be connected with the ligand via a linker or the like as long as the ligand-binding molecule is capable of binding to the ligand.

The ligand-binding molecule of the present invention is limited only by its binding to the ligand in an uncleaved state, and can be a molecule having any structure as long as it can bind to the ligand of interest in an uncleaved state. Examples of the ligand-binding molecule include, but are not limited to, an antibody heavy chain variable region (VH), an antibody light chain variable region (VL), a single-domain antibody (sdAb), a module called A domain of approximately 35 amino acids contained in a cell membrane protein avimer which is present in vivo (WO2004/044011 and WO2005/040229), adnectin containing a 10Fn3 domain which is a domain that binds to a protein in a glycoprotein fibronectin expressed on cell membranes (WO2002/032925), Affibody containing an IgG binding domain scaffold constituting a three-helix bundle composed of 58 amino acids of protein A (WO1995/001937), DARPins (designed ankyrin repeat proteins) which are molecular surface-exposed regions of ankyrin repeats (AR) having a structure in which a subunit comprising 33-amino acid residues and a turn, two antiparallel helices, and a loop is repeatedly stacked (WO2002/020565), anticalin having four loop regions that support one side of a barrel structure formed by eight antiparallel strands bent toward the central axis which is highly conserved in lipocalin molecules such as neutrophil gelatinase-associated lipocalin (NGAL) (WO2003/029462), and a depressed region in the internal parallel sheet structure of a horseshoe-shaped structure composed of repeated stacks of leucine-rich-repeat (LRR) modules of an immunoglobulin structure-free variable lymphocyte receptor (VLR) as seen in the acquired immune systems of jawless vertebrates such as lamprey and hagfish (WO2008/016854).

In the present specification, the term "antibody" is used in the broadest sense and encompasses various antibody structures including, but are not limited to, a monoclonal antibody, a polyclonal antibody, a multispecific antibody (e.g., a bispecific antibody), and an antibody fragment as long as the antibody exhibits the desired antigen binding activity.

A method for preparing an antibody having desired binding activity is known to those skilled in the art. Hereinafter, a method for preparing an antibody that binds to IL-6R (anti-IL-6R antibody) will be given as an example. Antibodies that bind to antigens other than IL-6R can also be appropriately prepared according to the example given below.

The anti-IL-6R antibody can be obtained as a polyclonal or monoclonal antibody by use of an approach known in the art. A mammal-derived monoclonal antibody can be preferably prepared as the anti-IL-6R antibody. The mammal-derived monoclonal antibody includes, for example, those produced by hybridomas and those produced by host cells transformed by a genetic engineering approach with an expression vector containing an antibody gene. The antibody described in the present application includes a "humanized antibody" and a "chimeric antibody".

The monoclonal antibody-producing hybridomas can be prepared by use of a technique known in the art, for example, as discussed below. Mammals are immunized with IL-6R protein used as a sensitizing antigen according to a usual immunization method. Immunocytes thus obtained are fused with known parental cells by a usual cell fusion method. Next, cells producing a monoclonal antibody are screened for selecting hybridomas producing the anti-IL-6R antibody by a usual screening method.

Specifically, the monoclonal antibody is prepared, for example, as discussed below. First, the IL-6R gene can be expressed to obtain the IL-6R protein which is used as a sensitizing antigen for antibody obtainment. Specifically, a gene sequence encoding IL-6R is inserted into a known expression vector with which appropriate host cells are then transformed. The desired human IL-6R protein is purified from the host cells or from a culture supernatant thereof by a method known in the art. In order to obtain soluble IL-6R from the culture supernatant, for example, soluble IL-6R as described by Mullberg et al. (J. Immunol. (1994) 152 (10), 4958-4968) is expressed. Alternatively, purified natural IL-6R protein can also be used as a sensitizing antigen.

The purified IL-6R protein can be used as the sensitizing antigen for use in the immunization of mammals. A partial peptide of IL-6R can also be used as the sensitizing antigen. The partial peptide may be obtained by chemical synthesis from the amino acid sequence of human IL-6R. Alternatively, the partial peptide may be obtained by incorporating a portion of the IL-6R gene to an expression vector followed by its expression. Furthermore, the partial peptide can also be obtained by degrading the IL-6R protein with a proteolytic enzyme. The region and size of the IL-6R peptide for use as a partial peptide are not particularly limited by specific embodiments. The number of amino acids constituting a peptide to be used as the sensitizing antigen is preferably at least 5 or more, for example, 6 or more, or 7 or more. More specifically, a peptide of 8 to 50, preferably 10 to 30 residues can be used as the sensitizing antigen.

Also, a fusion protein comprising a desired partial polypeptide or peptide of the IL-6R protein fused with a different polypeptide can be used as the sensitizing antigen. For example, an antibody Fc fragment or a peptide tag can be preferably used for producing the fusion protein for use as the sensitizing antigen. A vector for the expression of the fusion protein can be prepared by fusing in frame genes encoding two or more types of the desired polypeptide fragments, and inserting the fusion gene into an expression vector as described above. The method for preparing the fusion protein is described in Molecular Cloning 2nd ed. (Sambrook, J. et al., Molecular Cloning 2nd ed., 9.47-9.58 (1989), Cold Spring Harbor Lab. Press). The method for obtaining IL-6R for use as the sensitizing antigen and the immunization method using it are also specifically described in WO2003/000883, WO2004/022754, WO2006/006693, etc.

The mammals to be immunized with the sensitizing antigen are not limited to particular animals and are preferably selected in consideration of compatibility with the parental cells for use in cell fusion. In general, rodents (e.g., mice, rats, and hamsters), rabbits, monkeys, or the like are preferably used.

The above animals are immunized with the sensitizing antigen according to a method known in the art. For example, as a general method, immunization is carried out by administering the sensitizing antigen to the mammals by intraperitoneal or subcutaneous administration. Specifically, the sensitizing antigen diluted with PBS (phosphate-buffered saline), physiological saline, or the like at an appropriate dilution ratio is mixed, if desired, with a usual adjuvant, for example, a Freund's complete adjuvant and emulsified. Then, the resulting sensitizing antigen is administered to the mammals several times at 4- to 21-day intervals. Also, an appropriate carrier can be used in the immunization with the sensitizing antigen. Particularly, in the case of using a partial peptide having a small molecular weight as the sensitizing antigen, immunization with the sensitizing antigen peptide bound with a carrier protein such as albumin or keyhole limpet hemocyanin may be desirable in some cases.

Alternatively, hybridomas producing the desired antibody can also be prepared as described below by use of DNA immunization. DNA immunization is an immunization method which involves immunostimulating immunized animals by expressing in vivo the sensitizing antigen in the immunized animals administered with a vector DNA that has been constructed in a form capable of expressing the gene encoding the antigenic protein in the immunized animals. DNA immunization can be expected to be superior to the general immunization method in which a protein antigen is administered to animals to be immunized as follows:

DNA immunization can provide immunostimulation while maintaining the structure of a membrane protein (e.g., IL-6R); and DNA immunization does not require purification of the immunizing antigen.

In order to obtain a monoclonal antibody of the present invention by DNA immunization, first, DNA for IL-6R protein expression is administered to the animals to be immunized. The DNA encoding IL-6R can be synthesized by a method known in the art such as PCR. The obtained DNA is inserted into an appropriate expression vector, which is then administered to the animals to be immunized. For example, a commercially available expression vector such as pcDNA3.1 can be preferably used as the expression vector. A generally used method can be used as a method for administering the vector to a living body. For example, gold particles with the expression vector adsorbed thereon are transfected into the cells of animal individuals to be immunized using a gene gun to thereby perform DNA immunization. Furthermore, an antibody recognizing IL-6R can also be prepared by use of a method described in WO 2003/104453.

A rise in the titer of the antibody binding to IL-6R is confirmed in the serum of the mammals thus immunized. Then, immunocytes are collected from the mammals and subjected to cell fusion. Particularly, spleen cells can be used as preferred immunocytes.

Mammalian myeloma cells are used as cells to be fused with the immunocytes. The myeloma cells preferably have an appropriate selection marker for screening. The selection marker refers to a trait that can survive (or cannot survive) under particular culture conditions. For example, hypoxanthine guanine phosphoribosyltransferase deficiency (hereinafter, abbreviated as HGPRT deficiency) or thymidine kinase deficiency (hereinafter, abbreviated as TK deficiency) is known as the selection marker. Cells having the HGPRT or TK deficiency are sensitive to hypoxanthine aminopterin thymidine (hereinafter, abbreviated as HAT-sensitive). HAT-sensitive cells are killed in a HAT selective medium because the cells fail to synthesize DNA. By contrast, these cells, when fused with normal cells, become able to grow even in the HAT selective medium because the fused cells can continue DNA synthesis through the use of the salvage pathway of the normal cells.

Cells having HGPRT or TK deficiency can be selected in a medium containing 6-thioguanine or 8-azaguanine (hereinafter, abbreviated as 8AG) or 5'-bromodeoxyuridine, respectively. The normal cells are killed by incorporating these pyrimidine analogs into their DNAs. By contrast, the cells deficient in these enzymes can survive in the selective medium because the cells cannot incorporate the pyrimidine analogs. In addition, a selection marker called G418 resistance confers resistance to a 2-deoxystreptamine antibiotic (gentamicin analog) through a neomycin resistance gene. Various myeloma cells suitable for cell fusion are known in the art.

For example, P3 (P3x63Ag8.653) (J. Immunol. (1979) 123 (4), 1548-1550), P3x63Ag8U.1 (Current Topics in Microbiology and Immunology (1978) 81, 1-7), NS-1 (C. Eur. J. Immunol. (1976) 6 (7), 511-519), MPC-11 (Cell (1976) 8 (3), 405-415), SP2/0 (Nature (1978) 276 (5685), 269-270), FO (J. Immunol. Methods (1980) 35 (1-2), 1-21), S194/5.XX0.BU.1 (J. Exp. Med. (1978) 148 (1), 313-323), and R210 (Nature (1979) 277 (5692), 131-133) can be preferably used as such myeloma cells.

Basically, cell fusion of the immunocytes with the myeloma cells is performed according to a method known in the art, for example, the method of Kohler and Milstein et al. (Methods Enzymol. (1981) 73, 3-46).

More specifically, cell fusion can be carried out, for example, in a usual nutrient medium in the presence of a cell fusion promoter. For example, polyethylene glycol (PEG) or hemagglutinating virus of Japan (HVJ) is used as the fusion promoter. In addition, an auxiliary such as dimethyl sulfoxide is added thereto, if desired, for enhancing fusion efficiency and then used.

The ratio between the immunocytes and the myeloma cells used can be arbitrarily set. For example, the amount of the immunocytes is preferably set to 1 to 10 times the amount of the myeloma cells. For example, an RPMI1640 medium or a MEM medium suitable for the growth of the myeloma cell line as well as a usual medium for use in this kind of cell culture is used as the medium in the cell fusion. Preferably, a solution supplemented with serum (e.g., fetal calf serum (FCS)) can be further added to the medium.

For cell fusion, predetermined amounts of the immunocytes and the myeloma cells are mixed well in the medium, and a PEG solution (e.g., average molecular weight of PEG of about 1000 to 6000) preheated to approximately 37° C. is added thereto usually at a concentration of 30 to 60% (w/v). The mixed solution is gently mixed and the desired fusion cells (hybridomas) are thus formed. Subsequently, appropriate medium listed above is sequentially added, and the supernatant is removed by centrifugation. This operation can be repeated to remove cell fusion agents or the like unfavorable for hybridoma growth.

The hybridomas thus obtained can be cultured in a usual selective medium, for example, a HAT medium (medium containing hypoxanthine, aminopterin, and thymidine), for selection. The culture using the HAT medium can be continued for a time sufficient (usually, sufficient time is several days to several weeks) to kill cells other than the desired hybridomas (non-fused cells). Subsequently, hybridomas producing the desired antibody are screened for and single-cell-cloned by a usual limiting dilution method.

The hybridomas thus obtained can be selected through the use of a selective medium according to the selection marker possessed by the myeloma cells used in the cell fusion. For example, cells having HGPRT or TK deficiency can be selected by culturing in a HAT medium (medium containing hypoxanthine, aminopterin, and thymidine). Specifically, in the case of using HAT-sensitive myeloma cells in cell fusion, cells successfully fused with normal cells can grow selectively in the HAT medium. The culture using the HAT medium is continued for a time long enough to kill cells other than the desired hybridomas (non-fused cells). Specifically, the culture can generally be performed for several days to several weeks to select the desired hybridomas. Subsequently, hybridomas producing the desired antibody can be screened for and single-cell-cloned by a usual limiting dilution method.

Screening and single-cell-cloning of the desired antibody can be preferably carried out by a screening method based on known antigen-antibody reactions. For example, a monoclonal antibody that binds to IL-6R can bind to IL-6R expressed on the cell surface. Such a monoclonal antibody can be screened, for example, by FACS (fluorescence activated cell sorting). FACS is a system capable of measuring the binding of an antibody to the cell surface by analyzing cells contacted with a fluorescent antibody using laser beam, and measuring the fluorescence emitted from the individual cells.

In order to screen for hybridomas that produce the monoclonal antibody of the present invention by FACS, first, IL-6R-expressing cells are prepared. Cells preferred for screening are mammalian cells forced to express IL-6R. Untransformed mammalian cells used as host cells can be used as a control to selectively detect the binding activity of an antibody against IL-6R on the cell surface. Specifically, hybridomas producing the IL-6R monoclonal antibody can be obtained by selecting hybridomas producing an antibody that binds to cells forced to express IL-6R but that does not bind to the host cells.

Alternatively, the antibody can be evaluated for its binding activity against immobilized IL-6R-expressing cells on the basis of the principle of ELISA. The IL-6R-expressing cells are immobilized onto each well of, for example, an ELISA plate. The hybridoma culture supernatant is contacted with the immobilized cells in the well to detect an antibody that binds to the immobilized cells. When the monoclonal antibody is derived from a mouse, the antibody bound with the cell can be detected using an anti-mouse immunoglobulin antibody. Hybridomas producing the desired antibody having antigen binding capacity thus selected by screening can be cloned by a limiting dilution method or the like.

The monoclonal antibody-producing hybridomas thus prepared can be passage cultured in a usual medium. Further, the hybridomas can be preserved over a long period in liquid nitrogen.

The hybridomas are cultured according to a usual method, and the desired monoclonal antibody can be obtained from the culture supernatant thereof. Alternatively, the hybridomas may be administered to mammals compatible therewith and grown, and the monoclonal antibody can be obtained from the ascitic fluids of the mammals. The former method is suitable for obtaining highly pure antibodies.

An antibody encoded by an antibody gene cloned from antibody-producing cells such as hybridomas can also be preferably used. The cloned antibody gene is integrated to an appropriate vector, which is then transfected into hosts so that the antibody encoded by the gene is expressed. Methods for isolating an antibody gene, integrating the gene to a vector, and transforming a host cell are already established by, for example, Vandamme et al. (Eur. J. Biochem. (1990) 192 (3), 767-775). A method for producing a recombinant antibody is also known, as mentioned below.

For example, cDNA encoding the variable region (V region) of the anti-IL-6R antibody is obtained from hybridoma cells producing the anti-IL-6R antibody. For this purpose, usually, total RNA is first extracted from the hybridomas. For example, the following methods can be used as a method for extracting mRNA from cells:

a guanidine ultracentrifugation method (Biochemistry (1979) 18 (24), 5294-5299), and an AGPC method (Anal. Biochem. (1987) 162 (1), 156-159).

The extracted mRNA can be purified using mRNA Purification Kit (manufactured by GE Healthcare Bio-Sciences Corp.) or the like. Alternatively, a kit for directly extracting total mRNA from cells is also commercially available, such as QuickPrep mRNA Purification Kit (manufactured by GE Healthcare Bio-Sciences Corp.). The mRNA can be obtained from hybridomas using such a kit. From the obtained mRNA, cDNA encoding the antibody V region can be synthesized using reverse transcriptase. The cDNA can be synthesized using, for example, AMV Reverse Transcriptase First-strand cDNA Synthesis Kit (manufactured by Seikagaku Corp.). Alternatively, a 5'-RACE method (Proc. Natl. Acad. Sci. USA (1988) 85 (23), 8998-9002; and Nucleic Acids Res. (1989) 17 (8), 2919-2932) using SMART RACE cDNA amplification kit (manufactured by Clontech Laboratories, Inc.) and PCR can be appropriately used for cDNA synthesis and amplification. In the course of such cDNA synthesis, appropriate restriction enzyme sites mentioned later can be further introduced to both ends of the cDNA.

The cDNA fragment of interest is purified from the obtained PCR product and subsequently ligated with vector DNA. The recombinant vector thus prepared is transfected into E. coli or the like. After colony selection, the desired recombinant vector can be prepared from the E. coli that has formed the colony. Then, whether or not the recombinant vector has the nucleotide sequence of the cDNA of interest is confirmed by a method known in the art, for example, a dideoxynucleotide chain termination method.

The 5'-RACE method using primers for amplifying a variable region gene is conveniently used for obtaining a gene encoding the variable region. First, a 5'-RACE cDNA library is obtained by cDNA synthesis using RNAs extracted from hybridoma cells as templates. A commercially available kit such as SMART RACE cDNA amplification kit is appropriately used in the synthesis of the 5'-RACE cDNA library.

The antibody gene is amplified by PCR using the obtained 5'-RACE cDNA library as a template. Primers for amplifying mouse antibody genes can be designed on the basis of a known antibody gene sequence. These primers have nucleotide sequences differing depending on immunoglobulin subclasses. Thus, the subclass is desirably determined in advance using a commercially available kit such as Iso Strip mouse monoclonal antibody isotyping kit (Roche Diagnostics K.K.).

Specifically, primers capable of amplifying genes encoding γ1, γ2a, γ2b, and γ3 heavy chains and κ and λ light chains can be used, for example, for the purpose of obtaining a gene encoding mouse IgG. In order to amplify an IgG variable region gene, a primer that anneals to a moiety corresponding to a constant region close to the variable region is generally used as a 3' primer. On the other hand, a primer attached to the 5' RACE cDNA library preparation kit is used as a 5' primer.

The PCR products thus obtained by amplification can be used to reshape immunoglobulins composed of combinations of heavy and light chains. The desired antibody can be screened for using the binding activity of the reshaped immunoglobulin against IL-6R as an index. More preferably, the binding of the antibody to IL-6R is specific, for example, for the purpose of obtaining an antibody against IL-6R. An antibody that binds to IL-6R can be screened for, for example, by the following steps:

(1) contacting IL-6R-expressing cells with an antibody containing the V region encoded by the cDNA obtained from the hybridomas;

(2) detecting the binding of the antibody to the IL-6R-expressing cells; and (3) selecting the antibody binding to the IL-6R-expressing cells.

A method for detecting the binding of an antibody to IL-6R-expressing cells is known in the art. Specifically, the binding of an antibody to IL-6R-expressing cells can be detected by an approach such as FACS mentioned above. A fixed preparation of IL-6R-expressing cells can be appropriately used for evaluating the binding activity of the antibody.

A panning method using phage vectors is also preferably used as a method of screening for an antibody using binding activity as an index. When antibody genes are obtained as libraries of heavy chain and light chain subclasses from a polyclonal antibody-expressing cell population, a screening method using phage vectors is advantageous. Genes encoding heavy chain and light chain variable regions can be linked via an appropriate linker sequence to form a single-chain Fv (scFv). The gene encoding scFv can be inserted into phage vectors to obtain phages expressing scFv on their surface. After contacting the phages with the desired antigen, phages bound with the antigen can be recovered to recover DNA encoding scFv having the binding activity of interest. This operation can be repeated as necessary to enrich scFvs having the desired binding activity.

After obtaining the cDNA encoding the V region of the anti-IL-6R antibody of interest, this cDNA is digested with restriction enzymes that recognize the restriction sites inserted at both ends of the cDNA. The restriction enzymes preferably recognize and digest a nucleotide sequence that appears at low frequency in the nucleotide sequence constituting the antibody gene. Preferably, sites for restriction enzymes that provide cohesive ends are inserted for inserting one copy of the digested fragment in the correct orientation into a vector. The thus-digested cDNA encoding the V region of the anti-IL-6R antibody can be inserted into an appropriate expression vector to obtain an antibody expression vector. In this case, a gene encoding an antibody constant region (C region) and the gene encoding the V region are fused in frame to obtain a chimeric antibody. In this context, a "chimeric antibody" implies that the origin of the constant and variable regions is different. Thus, heterogeneous (e.g., mouse-human) chimeric antibodies as well as human-human homogeneous chimeric antibodies are also included in the chimeric antibody according to the present invention. The V region gene can be inserted into an expression vector preliminarily having a constant region gene to construct a chimeric antibody expression vector. Specifically, for example, a recognition sequence for a restriction enzyme that digests the V region gene can be appropriately placed on the 5' side of an expression vector carrying the DNA encoding the desired antibody constant region (C region). Both are digested with the same combination of restriction enzymes and are fused in frame to construct a chimeric antibody expression vector.

In order to produce the anti-IL-6R monoclonal antibody, the antibody gene is integrated to an expression vector such that the antibody gene is expressed under the control of expression control regions. The expression control regions for antibody expression include, for example, an enhancer and a promoter. Also, an appropriate signal sequence can be added to the amino terminus such that the expressed antibody is extracellularly secreted. For example, a peptide having an amino acid sequence MGWSCIILFL-VATATGVHS (SEQ ID NO: 536) can be used as the signal sequence, and other suitable signal sequences may be added. The expressed polypeptide is cleaved at the carboxyl-terminal moiety of the above sequence. The cleaved polypeptide can be extracellularly secreted as a mature polypeptide. Subsequently, appropriate host cells can be transformed with this expression vector to obtain recombinant cells expressing DNA encoding the anti-IL-6R antibody.

"Antibody fragment" refers to a molecule, other than a complete antibody, including a portion of a complete antibody and binding to an antigen to which the complete antibody binds. Examples of the antibody fragment include, but are not limited to, Fv, Fab, Fab', Fab'-SH, F(ab')2, diabodies, linear antibodies, single-chain antibody molecules (e.g., scFv), and multispecific antibodies formed from antibody fragments.

The terms "full-length antibody", "complete antibody", and "whole antibody" are used interchangeably with each other in the present specification and refer to an antibody having a structure substantially similar to a natural antibody structure, or having a heavy chain containing an Fc region defined in the present specification.

The term "variable region" or "variable domain" refers to a domain of an antibody heavy chain or light chain involved in the binding of the antibody to its antigen. Usually, antibody heavy chain and light chain variable domains (VH and VL, respectively) have a similar structure and each domain contains 4 conserved framework regions (FRs) and 3 complementarity determining regions (CDRs) (see, e.g., Kindt et al., Kuby Immunology, 6th ed., W.H. Freeman and Co., page 91 (2007)). One VH or VL domain should be sufficient for conferring antigen binding specificity.

The term "complementarity determining region" or "CDR" used in the present specification refers to a site which is hypervariable in the sequence, and/or forms a structurally determined loop ("hypervariable loop"), and/or refers to antigen-contacting residues ("antigen contacts"), or to each region of an antibody variable domain. Usually, an antibody contains 6 CDRs: three in VH (H1, H2, and H3), and three in VL (L1, L2, and L3). In the present specification, exemplary CDRs include the following:
  (a) hypervariable loops formed at amino acid residues 26 to 32 (L1), 50 to 52 (L2), 91 to 96 (L3), 26 to 32 (H1), 53 to 55 (H2), and 96 to 101 (H3) (Chothia and Lesk, J. Mol. Biol. 196:901-917 (1987));
  (b) CDRs formed at amino acid residues 24 to 34 (L1), 50 to 56 (L2), 89 to 97 (L3), 31 to 35b (H1), 50 to 65 (H2), and 95 to 102 (H3) (Kabat et al., Sequences of Proteins of Immunological Interest, 5th Ed. Public Health Service, National Institutes of Health, Bethesda, MD (1991));
  (c) antigen contacts formed at amino acid residues 27c to 36 (L1), 46 to 55 (L2), 89 to 96 (L3), 30 to 35b (H1), 47 to 58 (H2), and 93 to 101 (H3) (MacCallum et al., J. Mol. Biol. 262:732-745 (1996)); and
  (d) a combination of (a), (b), and/or (c) containing HVR amino acid residues 46 to 56 (L2), 47 to 56 (L2), 48 to 56 (L2), 49 to 56 (L2), 26 to 35 (H1), 26 to 35b (H1), 49 to 65 (H2), 93 to 102 (H3), and 94 to 102 (H3).

In the present specification, CDR residues and other residues (e.g., FR residues) in a variable domain are numbered according to Kabat et al. (supra), unless otherwise specified.

The term "framework" or "FR" refers to variable domain residues other than complementarity determining region (CDR) residues. FRs in a variable domain usually consist of 4 FR domains: FR1, FR2, FR3, and FR4. Accordingly, the sequences of CDRs and FRs usually appear in VH (or VL) in the following order: FR1-H1 (L1)-FR2-H2 (L2)-FR3-H3 (L3)-FR4.

In the present specification, the term "constant region" or "constant domain" refers to a part other than variable regions in an antibody. For example, an IgG antibody is a heterotetrameric glycoprotein of approximately 150,000 Da constituted by two identical light chains and two identical heavy chains connected through disulfide bonds. Each heavy chain has a variable region (VH) also called variable heavy chain domain or heavy chain variable domain, followed by a heavy chain constant region (CH) containing a CH1 domain, a hinge region, a CH2 domain, and a CH3 domain, from the N terminus to the C terminus. Likewise, each light chain has a variable region (VL) also called variable light chain domain or light chain variable domain, followed by a constant light chain (CL) domain, from the N terminus to the C terminus. The light chains of natural antibodies may be attributed to one of two types called kappa (κ) and lambda (λ) on the basis of the amino acid sequences of their constant domains.

The "class" of an antibody refers to the type of a constant domain or a constant region carried by the heavy chain of the antibody. Antibodies have 5 major classes: IgA, IgD, IgE, IgG, and IgM. Some of these classes may be further divided into subclasses (isotypes), for example, IgG1, IgG2, IgG3, IgG4, IgA1, and IgA2. Heavy chain constant domains corresponding to immunoglobulins of different classes are called α, δ, ε, γ, and μ, respectively.

In the present specification, the term "Fc region" is used for defining the C-terminal region of immunoglobulin heavy chains, including at least a portion of constant regions. This term includes an Fc region having a natural sequence and a mutant Fc region. In one embodiment, the heavy chain Fc region of human IgG1 spans from Cys226 or from Pro230 to the carboxyl terminus of the heavy chain. However, the C-terminal lysine (Lys447) or glycine-lysine (Gly446-Lys447) of the Fc region may be present or absent. In the present specification, amino acid residues in an Fc region or a constant region are numbered according to the EU numbering system (also called EU index) described in Kabat et al., Sequences of Proteins of Immunological Interest, 5th Ed. Public Health Service, National Institutes of Health, Bethesda, MD 1991, unless otherwise specified.

The ligand-binding molecule of the present invention is a polypeptide comprising a cleavage site. The cleavage site can be cleaved by, for example, an enzyme, can be reduced with a reducing agent, or can be photodegraded. The cleavage site may be placed at any position in the polypeptide as long as the ligand binding of the ligand-binding molecule can be attenuated by the cleavage of the cleavage site. The polypeptide may contain one or more cleavage sites.

The ligand-binding molecule of the present invention binds to the ligand more weakly (i.e., ligand binding is attenuated) in a cleaved state compared with an uncleaved state. In an embodiment in which the ligand binding of the ligand-binding molecule is based on antigen-antibody reaction, attenuation of the ligand binding can be evaluated on the basis of the ligand binding activity of the ligand-binding molecule.

The binding activity of the ligand-binding molecule to a ligand can be assessed by a well-known method such as FACS, an ELISA format, a BIACORE® method using amplified luminescent proximity homogeneous assay (ALPHA) screening or surface plasmon resonance (SPR) phenomena, or bio-layer interferometry (BLI) (Octet®) (Proc. Natl. Acad. Sci. USA (2006) 103 (11), 4005-4010).

ALPHA screening is carried out based on the following principle according to ALPHA technology that uses two beads, a donor and an acceptor. Luminescence signals are detected only when molecules bound with the donor beads interact with molecules bound with the acceptor beads and when the two beads are close to one another. Laser-excited photosensitizers in the donor beads convert ambient oxygen into singlet oxygen in an excited state. The singlet oxygen molecules spread around the donor beads and when they reach the nearby acceptor beads, they induce chemiluminescent reaction in the beads to result in light emission. When the molecule bound with the donor bead and the molecule bound with the acceptor bead do not interact, chemiluminescent reaction does not occur because singlet oxygen produced by the donor bead does not reach the acceptor bead.

For example, a biotin-labeled ligand-binding molecule is bound to the donor bead, and a glutathione S transferase (GST)-tagged ligand is bound to the acceptor bead. In the absence of a competing untagged ligand-binding molecule, the ligand-binding molecule interacts with the ligand to generate signals of 520 to 620 nm. The untagged ligand-binding molecule competes with the tagged ligand-binding molecule for interaction with the ligand. Decrease in fluorescence resulting from the competition can be quantified to determine relative binding affinity. Biotinylation of a ligand-binding molecule, such as an antibody, using sulfo-NHS-biotin or the like is known in the art. A method which involves, for example, fusing a polynucleotide encoding the ligand in-frame with a polynucleotide encoding GST to form a fused gene, expressing the GST-fused ligand in cells or the like carrying a vector that permits expression of the fused gene, and purifying the GST-fused ligand using a glutathione column, can be appropriately adopted as a method for tagging a ligand with GST. The obtained signals are preferably analyzed using, for example, the software GRAPH-PAD PRISM (GraphPad Software, Inc., San Diego) adapted to a one-site competition model based on non-linear regression analysis.

One (ligand) of the substances between which the interaction is to be observed is immobilized onto a thin gold film of a sensor chip. The sensor chip is irradiated with light from the back such that total reflection occurs at the interface between the thin gold film and glass. As a result, a site having a drop in reflection intensity (SPR signal) is formed in a portion of reflected light. The other one (analyte) of the substances between which the interaction is to be observed is poured onto the surface of the sensor chip, and when the analyte binds with the ligand the mass of the immobilized ligand molecule increases and results in the change of refractive index of the solvent on the sensor chip surface. This change in refractive index shifts the position of the SPR signal (in contrast, the position of the signal returns when dissociation occurs). The Biacore® system plots on the ordinate the amount of the above-mentioned shift, i.e., change in mass on the sensor chip surface, and displays time-dependent change in mass as assay data (sensorgram). Kinetics (association rate constant (ka) and dissociation rate constant (kd)) is determined from the curve of the sensorgram, and dissociation constant (KD) is determined from the ratio between the two constants. Inhibition assay or equilibrium analysis is also preferably used in the BIACORE® method. Examples of inhibition assay are described in Proc. Natl. Acad. Sci. USA (2006) 103 (11), 4005-4010, and examples of equilibrium analysis are described in Methods Enzymol. 2000; 323:325-40.

The phrase "the function of a ligand-binding molecule to bind with a ligand is attenuated" means that the amount of ligand bound per a test ligand-binding molecule is, for example, 50% or less, preferably 45% or less, 40% or less, 35% or less, 30% or less, 20% or less, or 15% or less, particularly preferably 10% or less, 9% or less, 8% or less, 7% or less, 6% or less, 5% or less, 4% or less, 3% or less, 2% or less, or 1% or less, of the amount of ligand bound to a control ligand-binding molecule, on the basis of the measurement method described above. Desired index may be appropriately used as a binding activity index, and a dissociation constant (KD) may be used. In the case of using a dissociation constant (KD) as an index for evaluating binding activity, a larger dissociation constant (KD) of the test ligand-binding molecule for the ligand than the dissociation constant (KD) of a control ligand-binding molecule for the ligand means that the test ligand-binding molecule has weaker binding activity against the ligand than the control ligand-binding molecule. The phrase "the function of binding to a ligand is attenuated" means that the dissociation constant (KD) of the test ligand-binding molecule for the ligand is, for example, 2 times or more, preferably 5 times or more, or 10 times or more, and particularly preferably 100 times or more compared to the dissociation constant (KD) of the control ligand-binding molecule for the ligand.

Examples of the control ligand-binding molecule include an uncleaved form of a ligand-binding molecule.

In one embodiment of the present invention, in the ligand-binding molecule of the present invention, the ligand is released from the ligand-binding molecule by the cleavage of the cleavage site. In this context, when the ligand is bound with a portion of the ligand-binding molecule via a linker and the linker does not have a cleavage site, the ligand is released while connected with the portion of the ligand-binding molecule via the linker (see e.g., FIGS. 1A and 1B). Even when the ligand is released together with a portion of the ligand-binding molecule as mentioned above, it can be concluded that the ligand is released from the ligand-binding molecule as long as the ligand is released from the majority of the ligand-binding molecule.

A method for detecting the release of the ligand from the ligand-binding molecule by the cleavage of the cleavage site includes a method of detecting the ligand using, for example, an antibody for ligand detection that recognizes the ligand. When the ligand-binding molecule is an antibody fragment, the antibody for ligand detection preferably binds to the same epitope as that for the ligand-binding molecule. The ligand detected using the antibody for ligand detection can be confirmed by a well-known method such as FACS, an ELISA format, a BIACORE® method using amplified luminescent proximity homogeneous assay (ALPHA) screening or surface plasmon resonance (SPR) phenomena, or biolayer interferometry (BLI) (Octet®) (Proc. Natl. Acad. Sci. USA (2006) 103 (11), 4005-4010). In the case of detecting the release of the ligand using, for example, Octet®, the antibody for ligand detection that recognizes the ligand is biotinylated and contacted with a biosensor. Then, binding to the ligand in a sample can be measured to detect the release of the ligand. Specifically, the amount of the ligand is measured in a sample containing the ligand and the ligand-binding molecule before protease treatment or after protease treatment, using the antibody for ligand detection. The amount of the ligand detected in the sample can be compared between before and after protease treatment to detect the release of the ligand. Alternatively, the amount of the ligand is measured using the antibody for ligand detection in a sample containing protease, ligand-binding molecule, and ligand and a sample containing ligand-binding molecule and ligand without containing protease. The amount of the ligand detected in the sample with or without protease can be compared to detect the release of the ligand. More specifically, release of the ligand can be detected by a method described in the Examples of the present application. When the ligand-binding molecule is fused with the ligand to form a fusion protein, the amount of the ligand is measured using the antibody for ligand detection in a sample containing the fusion protein before protease treatment or after protease treatment. The amount of the ligand detected in the sample can be compared between before and after protease treatment to detect the release of the ligand. Alternatively, the amount of the ligand is measured using the antibody for ligand detection in a sample containing protease and the fusion protein and a sample containing the fusion protein without containing protease. The amount of the ligand detected in the sample with or without protease can be compared to detect the release of the ligand. More specifically, release of the ligand can be detected by a method described in the Examples of the present application.

In an embodiment in which the physiological activity of the ligand is inhibited upon binding to the ligand-binding molecule, a method for detecting the release of the ligand from the ligand-binding molecule includes measuring the physiological activity of the ligand in a sample for detecting ligand release. Specifically, the physiological activity of the ligand can be measured in a sample containing the ligand and the ligand-binding molecule before protease treatment or after protease treatment and then compared to detect the release of the ligand. Alternatively, the physiological activity of the ligand can be measured and compared in a sample containing protease, ligand-binding molecule, and ligand and a sample containing ligand-binding molecule and ligand without containing protease to detect the release of the ligand. When the ligand-binding molecule is fused with the ligand to form a fusion protein, the physiological activity of the ligand can be measured and compared in a sample containing the fusion protein before protease treatment or after protease treatment to detect the release of the ligand. Alternatively, the physiological activity of the ligand can be measured and compared in a sample containing protease and fusion protein and a sample containing fusion protein without containing protease to detect the release of the ligand.

In one embodiment of the present invention, the cleavage site comprises a protease cleavage sequence and is cleaved by protease.

In the present specification, the term "protease" refers to an enzyme such as endopeptidase or exopeptidase which hydrolyzes a peptide bond, and typically to an endopeptidase. The protease used in the present invention is limited only by its capacity to cleave the protease cleavage sequence and is not particularly limited by its type. In some embodiments, target tissue specific protease is used. The target tissue specific protease can refer to, for example, any of (1) protease that is expressed at a higher level in the target tissue than in normal tissues,
(2) protease that has higher activity in the target tissue than in normal tissues,
(3) protease that is expressed at a higher level in the target cells than in normal cells, and
(4) protease that has higher activity in the target cells than in normal cells.

In a more specific embodiment, a cancer tissue specific protease or an inflammatory tissue specific protease is used.

In the present specification, the term "target tissue" means a tissue containing at least one target cell. In some embodiments of the present invention, the target tissue is a cancer tissue. In some embodiments of the present invention, the target tissue is an inflammatory tissue.

The term "cancer tissue" means a tissue containing at least one cancer cell. Thus, considering that, for example, cancer tissue contains cancer cells and vascular vessels, every cell type that contributes to the formation of tumor mass containing cancer cells and endothelial cells is implied. In the present specification, tumor mass refers to a foci of tumor tissue. The term "tumor" is generally used to mean benign neoplasm or malignant neoplasm.

In the present specification, examples of "inflammatory tissue" include the following:
a joint in rheumatoid arthritis or osteoarthritis,
a lung (alveolus) in bronchial asthma or COPD,
a digestive organ in inflammatory bowel disease, Crohn disease, or ulcerative colitis,
a fibrotic tissue in fibrosis in the liver, the kidney, or the lung,
a tissue showing rejection reaction in organ transplantation,
a vascular vessel or heart (cardiac muscle) in arteriosclerosis or heart failure,
a visceral fat in metabolic syndrome,
a skin tissue in atopic dermatitis and other dermatitides, and
a spinal nerve in disk herniation or chronic lumbago.

In several types of target tissue, protease specifically expressed or specifically activated therein or protease considered to be related to the disease condition of the target tissue (target tissue specific protease) is known. For example, WO2013/128194, WO2010/081173, and WO2009/025846 disclose protease specifically expressed in cancer tissue. Also, J Inflamm (Lond). 2010; 7:45, Nat Rev Immunol. 2006 July; 6 (7): 541-50, Nat Rev Drug Discov. 2014 December; 13 (12): 904-27, Respir Res. 2016 Mar. 4; 17:23, Dis Model Mech. 2014 February; 7 (2): 193-203, and Biochim Biophys Acta. 2012 January; 1824 (1): 133-45 disclose protease considered to be related to inflammation.

In addition to the protease specifically expressed in a target tissue, there also exists protease that is specifically activated in a target tissue. For example, protease may be expressed in an inactive form and then become an active form. In many tissues, a substance that inhibits active protease is present, and activity is controlled by the process of activation and the presence of the inhibitor (Nat Rev Cancer. 2003 July; 3 (7): 489-501). In a target tissue, the active protease may be specifically activated by escaping inhibition. Active protease can be measured by use of a method using an antibody that recognizes the active protease (PNAS 2013 Jan. 2; 110 (1): 93-98) or a method in which a peptide recognized by protease is fluorescently labeled and the fluorescence is quenched before cleavage but emitted after cleavage (Nat Rev Drug Discov. 2010 September; 9 (9): 690-701. doi: 10.1038/nrd3053).

From one viewpoint, the term "target tissue specific protease" can refer to any of
  (i) protease that is expressed at a higher level in the target tissue than in normal tissues,
  (ii) protease that has higher activity in the target tissue than in normal tissues,
  (iii) protease that is expressed at a higher level in the target cells than in normal cells, and
  (iv) protease that has higher activity in the target cells than in normal cells.

Specific examples of the protease include, but are not limited to, cysteine protease (including cathepsin families B, L, S, etc.), aspartyl protease (cathepsins D, E, K, O, etc.), serine protease (including matriptase (including MT-SP1), cathepsins A and G, thrombin, plasmin, urokinase (uPA), tissue plasminogen activator (tPA), elastase, proteinase 3, thrombin, kallikrein, tryptase, and chymase), metalloprotease (metalloprotease (MMP1-28) including both membrane-bound forms (MMP14-17 and MMP24-25) and secreted forms (MMP1-13, MMP18-23, and MMP26-28), A disintegrin and metalloprotease (ADAM), A disintegrin and metalloprotease with thrombospondin motifs (ADAMTS), meprin (meprin alpha and meprin beta), CD10 (CALLA), prostate-specific antigen (PSA), legumain, TMPRSS3, TMPRSS4, human neutrophil elastase (HNE), beta secretase (BACE), fibroblast activation protein alpha (FAP), granzyme B, guanidinobenzoatase (GB), hepsin, neprilysin, NS3/4A, HCV-NS3/4, calpain, ADAMDEC1, renin, cathepsin C, cathepsin V/L2, cathepsin X/Z/P, cruzipain, otubain 2, kallikrein-related peptidases (KLKs (KLK3, KLK4, KLK5, KLK6, KLK7, KLK8, KLK10, KLK11, KLK13, and KLK14)), bone morphogenetic protein 1 (BMP-1), activated protein C, blood coagulation-related protease (Factor VIIa, Factor IXa, Factor Xa, Factor XIa, and Factor XIIa), HtrA1, lactoferrin, marapsin, PACE4, DESC1, dipeptidyl peptidase 4 (DPP-4), TMPRSS2, cathepsin F, cathepsin H, cathepsin L2, cathepsin O, cathepsin S, granzyme A, Gepsin calpain 2, glutamate carboxypeptidase 2, AMSH-like proteases, AMSH, gamma secretase, antiplasmin-cleaving enzyme (APCE), decysin 1, N-acetylated alpha-linked acidic dipeptidase-like 1 (NAALADL1), and furin.

From another viewpoint, the target tissue specific protease can refer to cancer tissue specific protease or inflammatory tissue specific protease.

Examples of the cancer tissue specific protease include protease specifically expressed in a cancer tissue disclosed in WO2013/128194, WO2010/081173, and WO2009/025846.

As for the type of the cancer tissue specific protease, protease having higher expression specificity in the cancer tissue to be treated is more effective for reducing adverse reactions. The concentration of cancer tissue specific protease in a cancer tissue is preferably 5 times or more, more preferably 10 times or more, further preferably 100 times or more, particularly preferably 500 times or more, and most preferably 1000 times or more than the concentration in normal tissues. Also, the activity of cancer tissue specific protease in a cancer tissue is preferably 2 times or more, more preferably 3 times or more, 4 times or more, 5 times or more, or 10 times or more, further preferably 100 times or more, particularly preferably 500 times or more, and most preferably 1000 times or more than the activity in normal tissues.

The cancer tissue specific protease may be bound to a cancer cell membrane or may be secreted extracellularly without being bound to a cell membrane. When the cancer tissue specific protease is not bound to a cancer cell membrane, the cancer tissue specific protease preferably exists within or in the vicinity of the cancer tissue in order for the cytotoxicity of immunocytes to be specific for cancer cells. In the present specification, "vicinity of the cancer tissue" means a position within the range that allows cleavage of the protease cleavage sequence specific for the cancer tissue to thereby exert the effect of reducing the ligand binding activity. Preferably, the range is such that damage on normal cells is minimized.

From an alternative viewpoint, cancer tissue specific protease is any of
  (i) protease that is expressed at a higher level in the cancer tissue than in normal tissues,
  (ii) protease that has higher activity in the cancer tissue than in normal tissues,
  (iii) protease that is expressed at a higher level in the cancer cells than in normal cells, and
  (iv) protease that has higher activity in the cancer cells than in normal cells.

One type of cancer tissue specific protease may be used alone, or two or more types may be used in combination. The number of types of cancer tissue specific protease can be appropriately set by those skilled in the art in consideration of the cancer type to be treated.

From the above viewpoints, the cancer tissue specific protease is preferably serine protease or metalloprotease, more preferably matriptase (including MT-SP1), urokinase (uPA), or metalloprotease, further preferably MT-SP1, uPA, MMP-2, or MMP-9, among the proteases listed above.

As for the type of inflammatory tissue specific protease, protease having higher expression specificity in the inflammatory tissue to be treated is more effective for reducing adverse reactions. The concentration of inflammatory tissue specific protease in an inflammatory tissue is preferably 5 times or more, more preferably 10 times or more, further preferably 100 times or more, particularly preferably 500 times or more, and most preferably 1000 times or more than the concentration in normal tissues. Also, the activity of inflammatory tissue specific protease in an inflammatory tissue is preferably 2 times or more, more preferably 3 times or more, 4 times or more, 5 times or more, or 10 times or more, further preferably 100 times or more, particularly preferably 500 times or more, most preferably 1000 times or more than the activity in normal tissues.

The inflammatory tissue specific protease may be bound to an inflammatory cell membrane or may be secreted extracellularly without being bound to a cell membrane. When the inflammatory tissue specific protease is not bound to an inflammatory cell membrane, the inflammatory tissue specific protease preferably exists within or in the vicinity of the inflammatory tissue in order for the cytotoxicity of immunocytes to be specific for inflammatory cells. In the present specification, "vicinity of the inflammatory tissue" means a position within the range that allows cleavage of the protease cleavage sequence specific for the inflammatory tissue to thereby exert the effect of reducing the ligand binding activity. Preferably, the range is such that damage on normal cells is minimized.

From an alternative viewpoint, inflammatory tissue specific protease is any of
(i) protease that is expressed at a higher level in the inflammatory tissue than in normal tissues,
(ii) protease that has higher activity in the inflammatory tissue than in normal tissues,
(iii) protease that is expressed at a higher level in the inflammatory cells than in normal cells, and
(iv) protease that has higher activity in the inflammatory cells than in normal cells.

One type of inflammatory tissue specific protease may be used alone, or two or more types may be used in combination. The number of types of inflammatory tissue specific protease can be appropriately set by those skilled in the art in consideration of the pathological condition to be treated.

From these viewpoints, the inflammatory tissue specific protease is preferably metalloprotease among the proteases listed above, and more preferably ADAMTS5, MMP-2, MMP-7, MMP-9, or MMP-13 among the metalloprotease.

The protease cleavage sequence is a particular amino acid sequence that is specifically recognized by a target tissue specific protease when a polypeptide is hydrolyzed by the target tissue specific protease in an aqueous solution.

The protease cleavage sequence is preferably an amino acid sequence that is hydrolyzed with high specificity by a target tissue specific protease that is more specifically expressed or activated in the target tissue or cells to be treated, from the viewpoint of reducing adverse reactions.

Specific examples of the protease cleavage sequence include target sequences that are specifically hydrolyzed by the above-illustrated protease specifically expressed in a cancer tissue as disclosed in WO2013/128194, WO2010/081173, and WO2009/025846, the inflammatory tissue specific protease, and the like. A sequence artificially altered by, for example, appropriately introducing an amino acid mutation to a target sequence that is specifically hydrolyzed by known protease can also be used. Alternatively, a protease cleavage sequence identified by a method known to those skilled in the art as described in Nature Biotechnology 19, 661-667 (2001) may be used.

Furthermore, a naturally occurring protease cleavage sequence may be used. For example, a protease-cleaved sequence present in a protein that changes its molecular form by protease cleavage, such as TGFß which is converted to a latent form by protease cleavage, can also be used.

Examples of the protease cleavage sequence that can be used include, but are not limited to, sequences disclosed in WO2015/116933, WO2015/048329, WO2016/118629, WO2016/179257, WO2016/179285, WO2016/179335, WO2016/179003, WO2016/046778, WO2016/014974, US2016/0289324, US2016/0311903, PNAS (2000) 97:7754-7759, Biochemical Journal (2010) 426:219-228, and Beilstein J Nanotechnol. (2016) 7:364-373.

The protease cleavage sequence is more preferably an amino acid sequence that is specifically hydrolyzed by a suitable target tissue specific protease as mentioned above.

The following amino acid sequences are preferable among the amino acid sequences that are specifically hydrolyzed by a target tissue specific protease:

LSGRSDNH (SEQ ID NO: 3, cleavable by MT-SP1 or uPA),

PLGLAG (SEQ ID NO: 34, cleavable by MMP-2 or MMP-9), and

VPLSLTMG (SEQ ID NO: 35, cleavable by MMP-7).

The following sequences can also be used as the protease cleavage sequence:

TSTSGRSANPRG (SEQ ID NO: 66, cleavable by MT-SP1 or uPA),

ISSGLLSGRSDNH (SEQ ID NO: 67, cleavable by MT-SP1 or uPA),

AVGLLAPPGGLSGRSDNH (SEQ ID NO: 68, cleavable by MT-SP1 or uPA),

GAGVPMSMRGGAG (SEQ ID NO: 69, cleavable by MMP-1),

GAGIPVSLRSGAG (SEQ ID NO: 70, cleavable by MMP-2),

GPLGIAGQ (SEQ ID NO: 71, cleavable by MMP-2),

GGPLGMLSQS (SEQ ID NO: 72, cleavable by MMP-2),

PLGLWA (SEQ ID NO: 73, cleavable by MMP-2),

GAGRPFSMIMGAG (SEQ ID NO: 74, cleavable by MMP-3),

GAGVPLSLTMGAG (SEQ ID NO: 75, cleavable by MMP-7),

GAGVPLSLYSGAG (SEQ ID NO: 76, cleavable by MMP-9),

AANLRN (SEQ ID NO: 77, cleavable by MMP-11),

AQAYVK (SEQ ID NO: 78, cleavable by MMP-11),

AANYMR (SEQ ID NO: 79, cleavable by MMP-11),

AAALTR (SEQ ID NO: 80, cleavable by MMP-11),

AQNLMR (SEQ ID NO: 81, cleavable by MMP-11),

AANYTK (SEQ ID NO: 82, cleavable by MMP-11),

GAGPQGLAGQRGIVAG (SEQ ID NO: 83, cleavable by MMP-13),

PRFKIIGG (SEQ ID NO: 84, cleavable by pro-urokinase),

PRFRIIGG (SEQ ID NO: 85, cleavable by pro-urokinase),

GAGSGRSAG (SEQ ID NO: 86, cleavable by uPA),

SGRSA (SEQ ID NO: 87, cleavable by uPA),

GSGRSA (SEQ ID NO: 88, cleavable by uPA),

SGKSA (SEQ ID NO: 89, cleavable by uPA),

SGRSS (SEQ ID NO: 90, cleavable by uPA),

SGRRA (SEQ ID NO: 91, cleavable by uPA),

SGRNA (SEQ ID NO: 92, cleavable by uPA),

SGRKA (SEQ ID NO: 93, cleavable by uPA),

QRGRSA (SEQ ID NO: 94, cleavable by tPA),

GAGSLLKSRMVPNFNAG (SEQ ID NO: 95, cleavable by cathepsin B)

TQGAAA (SEQ ID NO: 96, cleavable by cathepsin B),

GAAAAA (SEQ ID NO: 97, cleavable by cathepsin B),

GAGAAG (SEQ ID NO: 98, cleavable by cathepsin B),

AAAAAG (SEQ ID NO: 99, cleavable by cathepsin B),

LCGAAI (SEQ ID NO: 100, cleavable by cathepsin B),

FAQALG (SEQ ID NO: 101, cleavable by cathepsin B),

LLQANP (SEQ ID NO: 102, cleavable by cathepsin B),

LAAANP (SEQ ID NO: 103, cleavable by cathepsin B),

LYGAQF (SEQ ID NO: 104, cleavable by cathepsin B),

LSQAQG (SEQ ID NO: 105, cleavable by cathepsin B),

ASAASG (SEQ ID NO: 106, cleavable by cathepsin B),

FLGASL (SEQ ID NO: 107, cleavable by cathepsin B),

AYGATG (SEQ ID NO: 108, cleavable by cathepsin B),

LAQATG (SEQ ID NO: 109, cleavable by cathepsin B),

GAGSGVVIATVIVITAG (SEQ ID NO: 110, cleavable by cathepsin L),

APMAEGGG (SEQ ID NO: 111, cleavable by meprin alpha or meprin beta),

EAQGDKII (SEQ ID NO: 112, cleavable by meprin alpha or meprin beta),

LAFSDAGP (SEQ ID NO: 113, cleavable by meprin alpha or meprin beta),

YVADAPK (SEQ ID NO: 114, cleavable by meprin alpha or meprin beta),
RRRRR (SEQ ID NO: 115, cleavable by furin),
RRRRRR (SEQ ID NO: 116, cleavable by furin),
GQSSRHRRAL (SEQ ID NO: 117, cleavable by furin),
SSRHRRALD (SEQ ID NO: 118),
RKSSIIIRMRDVVL (SEQ ID NO: 119, cleavable by plasminogen),
SSSFDKGKYKKGDDA (SEQ ID NO: 120, cleavable by staphylokinase),
SSSFDKGKYKRGDDA (SEQ ID NO: 121, cleavable by staphylokinase),
IEGR (SEQ ID NO: 122, cleavable by Factor IXa),
IDGR (SEQ ID NO: 123, cleavable by Factor IXa),
GGSIDGR (SEQ ID NO: 124, cleavable by Factor IXa),
GPQGIAGQ (SEQ ID NO: 125, cleavable by collagenase),
GPQGLLGA (SEQ ID NO: 126, cleavable by collagenase),
GIAGQ (SEQ ID NO: 127, cleavable by collagenase),
GPLGIAG (SEQ ID NO: 128, cleavable by collagenase),
GPEGLRVG (SEQ ID NO: 129, cleavable by collagenase),
YGAGLGVV (SEQ ID NO: 130, cleavable by collagenase),
AGLGVVER (SEQ ID NO: 131, cleavable by collagenase),
AGLGISST (SEQ ID NO: 132, cleavable by collagenase),
EPQALAMS (SEQ ID NO: 133, cleavable by collagenase),
QALAMSAI (SEQ ID NO: 134, cleavable by collagenase),
AAYHLVSQ (SEQ ID NO: 135, cleavable by collagenase),
MDAFLESS (SEQ ID NO: 136, cleavable by collagenase),
ESLPVVAV (SEQ ID NO: 137, cleavable by collagenase),
SAPAVESE (SEQ ID NO: 138, cleavable by collagenase),
DVAQFVLT (SEQ ID NO: 139, cleavable by collagenase),
VAQFVLTE (SEQ ID NO: 140, cleavable by collagenase),
AQFVLTEG (SEQ ID NO: 141, cleavable by collagenase),
PVQPIGPQ (SEQ ID NO: 142, cleavable by collagenase),
LVPRGS (SEQ ID NO: 143, cleavable by thrombin),
TSGSGRSANARG (SEQ ID NO: 335),
TSQSGRSANQRG (SEQ ID NO: 336),
TSPSGRSAYPRG (SEQ ID NO: 337),
TSGSGRSATPRG (SEQ ID NO: 338),
TSQSGRSATPRG (SEQ ID NO: 339),
TSASGRSATPRG (SEQ ID NO: 340),
TSYSGRSAVPRG (SEQ ID NO: 341),
TSYSGRSANFRG (SEQ ID NO: 342),
TSSSGRSATPRG (SEQ ID NO: 343),
TSTTGRSASPRG (SEQ ID NO: 344), and
TSTSGRSANPRG (SEQ ID NO: 345).

The sequences shown in Table 1 may also be used as the protease cleavage sequence.

TABLE 1

Protease Cleavage Sequences (cleavable by uPA and MT-SP1)

| SEQ ID NO | Cleavage sequence | SEQ ID NO | Cleavage sequence |
|---|---|---|---|
| 538 | TSASGRSANPRG | 837 | ASGRSANP |
| 539 | TSESGRSANPRG | 838 | ESGRSANP |
| 540 | TSFSGRSANPRG | 839 | FSGRSANP |
| 541 | TSGSGRSANPRG | 840 | GSGRSANP |
| 542 | TSHSGRSANPRG | 841 | HSGRSANP |
| 543 | TSKSGRSANPRG | 842 | KSGRSANP |
| 544 | TSMSGRSANPRG | 843 | MSGRSANP |
| 545 | TSNSGRSANPRG | 844 | NSGRSANP |
| 546 | TSPSGRSANPRG | 845 | PSGRSANP |
| 547 | TSQSGRSANPRG | 846 | QSGRSANP |
| 548 | TSWSGRSANPRG | 847 | WSGRSANP |
| 549 | TSYSGRSANPRG | 848 | YSGRSANP |
| 550 | TSAGRSANPRG | 849 | TAGRSANP |
| 551 | TSTDGRSANPRG | 850 | TDGRSANP |
| 552 | TSTEGRSANPRG | 851 | TEGRSANP |
| 553 | TSTFGRSANPRG | 852 | TFGRSANP |
| 554 | TSTLGRSANPRG | 853 | TLGRSANP |
| 555 | TSTMGRSANPRG | 854 | TMGRSANP |
| 556 | TSTPGRSANPRG | 855 | TPGRSANP |
| 557 | TSTQGRSANPRG | 856 | TQGRSANP |
| 558 | TSTVGRSANPRG | 857 | TVGRSANP |
| 559 | TSTWGRSANPRG | 858 | TWGRSANP |
| 560 | TSTSARSANPRG | 859 | TSARSANP |
| 561 | TSTSERSANPRG | 860 | TSERSANP |
| 562 | TSTSFRSANPRG | 861 | TSFRSANP |
| 563 | TSTSHRSANPRG | 862 | TSHRSANP |
| 564 | TSTSIRSANPRG | 863 | TSIRSANP |
| 565 | TSTSKRSANPRG | 864 | TSKRSANP |
| 566 | TSTSLRSANPRG | 865 | TSLRSANP |
| 567 | TSTSMRSANPRG | 866 | TSMRSANP |
| 568 | TSTSNRSANPRG | 867 | TSNRSANP |
| 569 | TSTSPRSANPRG | 868 | TSPRSANP |
| 570 | TSTSQRSANPRG | 869 | TSQRSANP |
| 571 | TSTSRRSANPRG | 870 | TSRRSANP |
| 572 | TSTSTRSANPRG | 871 | TSTRSANP |
| 573 | TSTSVRSANPRG | 872 | TSVRSANP |
| 574 | TSTSWRSANPRG | 873 | TSWRSANP |

TABLE 1-continued

Protease Cleavage Sequences
(cleavable by uPA and MT-SP1)

| SEQ ID NO | Cleavage sequence | SEQ ID NO | Cleavage sequence |
|---|---|---|---|
| 575 | TSTSYRSANPRG | 874 | TSYRSANP |
| 576 | TSTSGRAANPRG | 875 | TSGRAANP |
| 577 | TSTSGRDANPRG | 876 | TSGRDANP |
| 578 | TSTSGREANPRG | 877 | TSGREANP |
| 579 | TSTSGRGANPRG | 878 | TSGRGANP |
| 580 | TSTSGRHANPRG | 879 | TSGRHANP |
| 581 | TSTSGRIANPRG | 880 | TSGRIANP |
| 582 | TSTSGRKANPRG | 881 | TSGRKANP |
| 583 | TSTSGRLANPRG | 882 | TSGRLANP |
| 584 | TSTSGRMANPRG | 883 | TSGRMANP |
| 585 | TSTSGRNANPRG | 884 | TSGRNANP |
| 586 | TSTSGRPANPRG | 885 | TSGRPANP |
| 587 | TSTSGRQANPRG | 886 | TSGRQANP |
| 588 | TSTSGRRANPRG | 887 | TSGRRANP |
| 589 | TSTSGRTANPRG | 888 | TSGRTANP |
| 590 | TSTSGRVANPRG | 889 | TSGRVANP |
| 591 | TSTSGRWANPRG | 890 | TSGRWANP |
| 592 | TSTSGRYANPRG | 891 | TSGRYANP |
| 593 | TSTSGRSENPRG | 892 | TSGRSENP |
| 594 | TSTSGRSFNPRG | 893 | TSGRSFNP |
| 595 | TSTSGRSKNPRG | 894 | TSGRSKNP |
| 596 | TSTSGRSMNPRG | 895 | TSGRSMNP |
| 597 | TSTSGRSNNPRG | 896 | TSGRSNNP |
| 598 | TSTSGRSPNPRG | 897 | TSGRSPNP |
| 599 | TSTSGRSQNPRG | 898 | TSGRSQNP |
| 600 | TSTSGRSRNPRG | 899 | TSGRSRNP |
| 601 | TSTSGRSSNPRG | 900 | TSGRSSNP |
| 602 | TSTSGRSWNPRG | 901 | TSGRSWNP |
| 603 | TSTSGRSYNPRG | 902 | TSGRSYNP |
| 604 | TSTSGRSAAPRG | 903 | TSGRSAAP |
| 605 | TSTSGRSADPRG | 904 | TSGRSADP |
| 606 | TSTSGRSAEPRG | 905 | TSGRSAEP |
| 607 | TSTSGRSAFPRG | 906 | TSGRSAFP |
| 608 | TSTSGRSAGPRG | 907 | TSGRSAGP |
| 609 | TSTSGRSAKPRG | 908 | TSGRSAKP |
| 610 | TSTSGRSALPRG | 909 | TSGRSALP |
| 611 | TSTSGRSAMPRG | 910 | TSGRSAMP |
| 612 | TSTSGRSAPPRG | 911 | TSGRSAPP |
| 613 | TSTSGRSAQPRG | 912 | TSGRSAQP |
| 614 | TSTSGRSAVPRG | 913 | TSGRSAVP |
| 615 | TSTSGRSAWPRG | 914 | TSGRSAWP |
| 616 | TSTSGRSAYPRG | 915 | TSGRSAYP |
| 617 | TSTSGRSANARG | 916 | TSGRSANA |
| 618 | TSTSGRSANDRG | 917 | TSGRSAND |
| 619 | TSTSGRSANERG | 918 | TSGRSANE |
| 620 | TSTSGRSANFRG | 919 | TSGRSANF |
| 621 | TSTSGRSANGRG | 920 | TSGRSANG |
| 622 | TSTSGRSANIRG | 921 | TSGRSANI |
| 623 | TSTSGRSANKRG | 922 | TSGRSANK |
| 624 | TSTSGRSANNRG | 923 | TSGRSANN |
| 625 | TSTSGRSANQRG | 924 | TSGRSANQ |
| 626 | TSTSGRSANSRG | 925 | TSGRSANS |
| 627 | TSTSGRSANTRG | 926 | TSGRSANT |
| 628 | TSTSGRSANWRG | 927 | TSGRSANW |
| 629 | TSDSGRSANPRG | 928 | DSGRSANP |
| 630 | TSISGRSANPRG | 929 | ISGRSANP |
| 631 | TSSSGRSANPRG | 930 | SSGRSANP |
| 632 | TSTHGRSANPRG | 931 | THGRSANP |
| 633 | TSTKGRSANPRG | 932 | TKGRSANP |
| 634 | TSTTGRSANPRG | 933 | TTGRSANP |
| 635 | TSTYGRSANPRG | 934 | TYGRSANP |
| 636 | TSTSDRSANPRG | 935 | TSDRSANP |
| 637 | TSTSSRSANPRG | 936 | TSSRSANP |
| 638 | TSTSGRFANPRG | 937 | TSGRFANP |
| 639 | TSTSGRSDNPRG | 938 | TSGRSDNP |
| 640 | TSTSGRSHNPRG | 939 | TSGRSHNP |
| 641 | TSTSGRSINPRG | 940 | TSGRSINP |
| 642 | TSTSGRSLNPRG | 941 | TSGRSLNP |
| 643 | TSTSGRSTNPRG | 942 | TSGRSTNP |
| 644 | TSTSGRSVNPRG | 943 | TSGRSVNP |
| 645 | TSTSGRSAHPRG | 944 | TSGRSAHP |
| 646 | TSTSGRSAIPRG | 945 | TSGRSAIP |
| 647 | TSTSGRSARPRG | 946 | TSGRSARP |
| 648 | TSTSGRSASPRG | 947 | TSGRSASP |

TABLE 1-continued

Protease Cleavage Sequences
(cleavable by uPA and MT-SP1)

| SEQ ID NO | Cleavage sequence | SEQ ID NO | Cleavage sequence |
|---|---|---|---|
| 649 | TSTSGRSATPRG | 948 | TSGRSATP |
| 650 | TSTSGRSANHRG | 949 | TSGRSANH |
| 651 | TSTSGRSANLRG | 950 | TSGRSANL |
| 652 | TSTSGRSANMRG | 951 | TSGRSANM |
| 653 | TSTSGRSANRRG | 952 | TSGRSANR |
| 654 | TSTSGRSANVRG | 953 | TSGRSANV |
| 655 | TSTSGRSANYRG | 954 | TSGRSANY |
| 656 | TSGSGRSAVPRG | 955 | GSGRSAVP |
| 657 | TSGSGRSAYPRG | 956 | GSGRSAYP |
| 658 | TSGSGRSANQRG | 957 | GSGRSANQ |
| 335 | TSGSGRSANARG | 958 | GSGRSANA |
| 659 | TSGSGRSANIRG | 959 | GSGRSANI |
| 660 | TSGSGRSANFRG | 960 | GSGRSANF |
| 661 | TSGSGRSANSRG | 961 | GSGRSANS |
| 662 | TSQSGRSAVPRG | 962 | QSGRSAVP |
| 663 | TSQSGRSAYPRG | 963 | QSGRSAYP |
| 336 | TSQSGRSANQRG | 964 | QSGRSANQ |
| 664 | TSQSGRSANARG | 965 | QSGRSANA |
| 665 | TSQSGRSANIRG | 966 | QSGRSANI |
| 666 | TSQSGRSANFRG | 967 | QSGRSANF |
| 667 | TSQSGRSANSRG | 968 | QSGRSANS |
| 668 | TSPSGRSAVPRG | 969 | PSGRSAVP |
| 337 | TSPSGRSAYPRG | 970 | PSGRSAYP |
| 669 | TSPSGRSANQRG | 971 | PSGRSANQ |
| 670 | TSPSGRSANARG | 972 | PSGRSANA |
| 671 | TSPSGRSANIRG | 973 | PSGRSANI |
| 672 | TSPSGRSANFRG | 974 | PSGRSANF |
| 673 | TSPSGRSANSRG | 975 | PSGRSANS |
| 674 | TSASGRSAVPRG | 976 | ASGRSAVP |
| 675 | TSASGRSAYPRG | 977 | ASGRSAYP |
| 676 | TSASGRSANQRG | 978 | ASGRSANQ |
| 677 | TSASGRSANARG | 979 | ASGRSANA |
| 678 | TSASGRSANIRG | 980 | ASGRSANI |
| 679 | TSASGRSANFRG | 981 | ASGRSANF |
| 680 | TSASGRSANSRG | 982 | ASGRSANS |
| 681 | TSYSGRSENPRG | 983 | YSGRSENP |
| 682 | TSGSGRSENPRG | 984 | GSGRSENP |
| 683 | TSQSGRSENPRG | 985 | QSGRSENP |
| 684 | TSPSGRSENPRG | 986 | PSGRSENP |
| 685 | TSASGRSENPRG | 987 | ASGRSENP |
| 686 | TSHSGRSENPRG | 988 | HSGRSENP |
| 687 | TSTSGRSENQRG | 989 | TSGRSENQ |
| 688 | TSTSGRSENARG | 990 | TSGRSENA |
| 689 | TSTSGRSENIRG | 991 | TSGRSENI |
| 690 | TSTSGRSENFRG | 992 | TSGRSENF |
| 691 | TSTSGRSENSRG | 993 | TSGRSENS |
| 692 | TSYSGRSAEPRG | 994 | YSGRSAEP |
| 693 | TSGSGRSAEPRG | 995 | GSGRSAEP |
| 694 | TSQSGRSAEPRG | 996 | QSGRSAEP |
| 695 | TSPSGRSAEPRG | 997 | PSGRSAEP |
| 696 | TSASGRSAEPRG | 998 | ASGRSAEP |
| 697 | TSHSGRSAEPRG | 999 | HSGRSAEP |
| 698 | TSTSGRSAEQRG | 1000 | TSGRSAEQ |
| 699 | TSTSGRSAEARG | 1001 | TSGRSAEA |
| 700 | TSTSGRSAEIRG | 1002 | TSGRSAEI |
| 701 | TSTSGRSAEFRG | 1003 | TSGRSAEF |
| 702 | TSTSGRSAESRG | 1004 | TSGRSAES |
| 703 | TSGTGRSANPRG | 1005 | GTGRSANP |
| 704 | TSGKGRSANPRG | 1006 | GKGRSANP |
| 705 | TSGSGRSAIPRG | 1007 | GSGRSAIP |
| 338 | TSGSGRSATPRG | 1008 | GSGRSATP |
| 706 | TSGSGRSASPRG | 1009 | GSGRSASP |
| 707 | TSGSGRSAHPRG | 1010 | GSGRSAHP |
| 708 | TSGSGRSANYRG | 1011 | GSGRSANY |
| 709 | TSGSGRSANVRG | 1012 | GSGRSANV |
| 710 | TSGSGRSANHRG | 1013 | GSGRSANH |
| 711 | TSQTGRSANPRG | 1014 | QTGRSANP |
| 712 | TSQKGRSANPRG | 1015 | QKGRSANP |
| 713 | TSQSGRSAIPRG | 1016 | QSGRSAIP |
| 339 | TSQSGRSATPRG | 1017 | QSGRSATP |
| 714 | TSQSGRSASPRG | 1018 | QSGRSASP |
| 715 | TSQSGRSAHPRG | 1019 | QSGRSAHP |
| 716 | TSQSGRSANYRG | 1020 | QSGRSANY |
| 717 | TSQSGRSANVRG | 1021 | QSGRSANV |

TABLE 1-continued

Protease Cleavage Sequences
(cleavable by uPA and MT-SP1)

| SEQ ID NO | Cleavage sequence | SEQ ID NO | Cleavage sequence |
|---|---|---|---|
| 718 | TSQSGRSANHRG | 1022 | QSGRSANH |
| 719 | TSPTGRSANPRG | 1023 | PTGRSANP |
| 720 | TSPKGRSANPRG | 1024 | PKGRSANP |
| 721 | TSPSGRSAIPRG | 1025 | PSGRSAIP |
| 722 | TSPSGRSATPRG | 1026 | PSGRSATP |
| 723 | TSPSGRSASPRG | 1027 | PSGRSASP |
| 724 | TSPSGRSAHPRG | 1028 | PSGRSAHP |
| 725 | TSPSGRSANYRG | 1029 | PSGRSANY |
| 726 | TSPSGRSANVRG | 1030 | PSGRSANV |
| 727 | TSPSGRSANHRG | 1031 | PSGRSANH |
| 728 | TSATGRSANPRG | 1032 | ATGRSANP |
| 729 | TSAKGRSANPRG | 1033 | AKGRSANP |
| 730 | TSASGRSAIPRG | 1034 | ASGRSAIP |
| 340 | TSASGRSATPRG | 1035 | ASGRSATP |
| 731 | TSASGRSASPRG | 1036 | ASGRSASP |
| 732 | TSASGRSAHPRG | 1037 | ASGRSAHP |
| 733 | TSASGRSANYRG | 1038 | ASGRSANY |
| 734 | TSASGRSANVRG | 1039 | ASGRSANV |
| 735 | TSASGRSANHRG | 1040 | ASGRSANH |
| 736 | TSYTGRSANPRG | 1041 | YTGRSANP |
| 737 | TSYKGRSANPRG | 1042 | YKGRSANP |
| 341 | TSYSGRSAVPRG | 1043 | YSGRSAVP |
| 738 | TSYSGRSAIPRG | 1044 | YSGRSAIP |
| 739 | TSYSGRSATPRG | 1045 | YSGRSATP |
| 740 | TSYSGRSASPRG | 1046 | YSGRSASP |
| 741 | TSYSGRSAHPRG | 1047 | YSGRSAHP |
| 742 | TSYSGRSANARG | 1048 | YSGRSANA |
| 342 | TSYSGRSANFRG | 1049 | YSGRSANF |
| 743 | TSYSGRSANYRG | 1050 | YSGRSANY |
| 744 | TSYSGRSANVRG | 1051 | YSGRSANV |
| 745 | TSYSGRSANHRG | 1052 | YSGRSANH |
| 746 | TSSTGRSANPRG | 1053 | STGRSANP |
| 747 | TSSKGRSANPRG | 1054 | SKGRSANP |
| 748 | TSSSGRSAVPRG | 1055 | SSGRSAVP |
| 749 | TSSSGRSAIPRG | 1056 | SSGRSAIP |
| 343 | TSSSGRSATPRG | 1057 | SSGRSATP |
| 750 | TSSSGRSASPRG | 1058 | SSGRSASP |
| 751 | TSSSGRSAHPRG | 1059 | SSGRSAHP |
| 752 | TSSSGRSANARG | 1060 | SSGRSANA |
| 753 | TSSSGRSANFRG | 1061 | SSGRSANF |
| 754 | TSSSGRSANYRG | 1062 | SSGRSANY |
| 755 | TSSSGRSANVRG | 1063 | SSGRSANV |
| 756 | TSSSGRSANHRG | 1064 | SSGRSANH |
| 757 | TSITGRSANPRG | 1065 | ITGRSANP |
| 758 | TSIKGRSANPRG | 1066 | IKGRSANP |
| 759 | TSISGRSAVPRG | 1067 | ISGRSAVP |
| 760 | TSISGRSAIPRG | 1068 | ISGRSAIP |
| 761 | TSISGRSATPRG | 1069 | ISGRSATP |
| 762 | TSISGRSASPRG | 1070 | ISGRSASP |
| 763 | TSISGRSAHPRG | 1071 | ISGRSAHP |
| 764 | TSISGRSANARG | 1072 | ISGRSANA |
| 765 | TSISGRSANFRG | 1073 | ISGRSANF |
| 766 | TSISGRSANYRG | 1074 | ISGRSANY |
| 767 | TSISGRSANVRG | 1075 | ISGRSANV |
| 768 | TSISGRSANHRG | 1076 | ISGRSANH |
| 769 | TSTTGRSAVPRG | 1077 | TTGRSAVP |
| 770 | TSTTGRSAIPRG | 1078 | TTGRSAIP |
| 771 | TSTTGRSATPRG | 1079 | TTGRSATP |
| 344 | TSTTGRSASPRG | 1080 | TTGRSASP |
| 772 | TSTTGRSAHPRG | 1081 | TTGRSAHP |
| 773 | TSTTGRSANARG | 1082 | TTGRSANA |
| 774 | TSTTGRSANFRG | 1083 | TTGRSANF |
| 775 | TSTTGRSANYRG | 1084 | TTGRSANY |
| 776 | TSTTGRSANVRG | 1085 | TTGRSANV |
| 777 | TSTTGRSANHRG | 1086 | TTGRSANH |
| 778 | TSTKGRSAVPRG | 1087 | TKGRSAVP |
| 779 | TSTKGRSAIPRG | 1088 | TKGRSAIP |
| 780 | TSTKGRSATPRG | 1089 | TKGRSATP |
| 781 | TSTKGRSASPRG | 1090 | TKGRSASP |
| 782 | TSTKGRSAHPRG | 1091 | TKGRSAHP |
| 783 | TSTKGRSANARG | 1092 | TKGRSANA |
| 784 | TSTKGRSANFRG | 1093 | TKGRSANF |
| 785 | TSTKGRSANYRG | 1094 | TKGRSANY |
| 786 | TSTKGRSANVRG | 1095 | TKGRSANV |

TABLE 1-continued

Protease Cleavage Sequences
(cleavable by uPA and MT-SP1)

| SEQ ID NO | Cleavage sequence | SEQ ID NO | Cleavage sequence | SEQ ID NO | Cleavage sequence | SEQ ID NO | Cleavage sequence |
|---|---|---|---|---|---|---|---|
| 787 | TSTKGRSANHRG | 1096 | TKGRSANH | 824 | TSYTGRSAVHRG | 1133 | YTGRSAVH |
| 788 | TSTSGRSAVYRG | 1097 | TSGRSAVY | 825 | TSYSGRSEVPRG | 1134 | YSGRSEVP |
| 789 | TSTSGRSAVVRG | 1098 | TSGRSAVV | 826 | TSYTGRSEVPRG | 1135 | YTGRSEVP |
| 790 | TSTSGRSAVHRG | 1099 | TSGRSAVH | 827 | TSYSGRSEVYRG | 1136 | YSGRSEVY |
| 791 | TSTSGRSAIYRG | 1100 | TSGRSAIY | 828 | TSYSGRSEVVRG | 1137 | YSGRSEVV |
| 792 | TSTSGRSAIVRG | 1101 | TSGRSAIV | 829 | TSYSGRSEVHRG | 1138 | YSGRSEVH |
| 793 | TSTSGRSAIHRG | 1102 | TSGRSAIH | 830 | TSYTGRSAVPGG | 1139 | YTGRSAVP |
| 794 | TSTSGRSASYRG | 1103 | TSGRSASY | 831 | TSYSGRSAVYGG | 1140 | YSGRSAVY |
| 795 | TSTSGRSASVRG | 1104 | TSGRSASV | 832 | TSYSGRSAVVGG | 1141 | YSGRSAVV |
| 796 | TSTSGRSASHRG | 1105 | TSGRSASH | 833 | TSYSGRSAVHGG | 1142 | YSGRSAVH |
| 797 | TSTSGRSAHYRG | 1106 | TSGRSAHY | 834 | TSYTGRSAVYGG | 1143 | YTGRSAVY |
| 798 | TSTSGRSAHVRG | 1107 | TSGRSAHV | 835 | TSYTGRSAVVGG | 1144 | YTGRSAVV |
| 799 | TSTSGRSAHHRG | 1108 | TSGRSAHH | 836 | TSYTGRSAVHGG | 1145 | YTGRSAVH |
| 800 | TSPSGRSEVPRG | 1109 | PSGRSEVP | 1183 | TSTSGRSANPRG | 1235 | TSYTGRSANPLG |
| 801 | TSPSGRSAEPRG | 1110 | PSGRSAEP | 1184 | TSTSGRSANPAG | 1236 | TSYSGRSAIPLG |
| 802 | TSPSGRSAGPRG | 1111 | PSGRSAGP | 1185 | TSTSGRSANPHG | 1237 | TSISGRSANYLG |
| 803 | TSASGRSENARG | 1112 | ASGRSENA | 1186 | TSTSGRSANPIG | 1238 | TSPSGRSAGPLG |
| 804 | TSASGRSAEARG | 1113 | ASGRSAEA | 1187 | TSTSGRSANPLG | 1239 | TSYTGRSAVPLG |
| 805 | TSASGRSAGARG | 1114 | ASGRSAGA | 1188 | TSTSGRSANPSG | 1240 | TSYTGRSAVYLG |
| 806 | TSGTGRSATPRG | 1115 | GTGRSATP | 1189 | ISTSGRSANPIG | 1241 | TSYTGRSAVVLG |
| 807 | TSGSGRSATYRG | 1116 | GSGRSATY | 1190 | YSTSGRSANPIG | 1242 | TSYTGRSAVHLG |
| 808 | TSGSGRSATVRG | 1117 | GSGRSATV | 1191 | TSYSGRSAVPAG | 1243 | TSYSGRSAVPSG |
| 809 | TSGSGRSATHRG | 1118 | GSGRSATH | 1192 | TSPSGRSANIAG | 1244 | TSPSGRSANISG |
| 810 | TSGTGRSATYRG | 1119 | GTGRSATY | 1193 | TSPSGRSANFAG | 1245 | TSPSGRSANFSG |
| 811 | TSGTGRSATVRG | 1120 | GTGRSATV | 1194 | TSPTGRSANPAG | 1246 | TSPTGRSANPSG |
| 812 | TSGTGRSATHRG | 1121 | GTGRSATH | 1195 | TSPSGRSAIPAG | 1247 | TSPSGRSAIPSG |
| 813 | TSGSGRSETPRG | 1122 | GSGRSETP | 1196 | TSYTGRSANPAG | 1248 | TSYTGRSANPSG |
| 814 | TSGTGRSETPRG | 1123 | GTGRSETP | 1197 | TSYSGRSAIPAG | 1249 | TSYSGRSAIPSG |
| 815 | TSGSGRSETYRG | 1124 | GSGRSETY | 1198 | TSISGRSANYAG | 1250 | TSISGRSANYSG |
| 816 | TSGSGRSETVRG | 1125 | GSGRSETV | 1199 | TSPSGRSAGPAG | 1251 | TSPSGRSAGPSG |
| 817 | TSGSGRSETHRG | 1126 | GSGRSETH | 1200 | TSYTGRSAVPAG | 1252 | TSYTGRSAVPSG |
| 818 | TSYTGRSAVPRG | 1127 | YTGRSAVP | 1201 | TSYTGRSAVYAG | 1253 | TSYTGRSAVYSG |
| 819 | TSYSGRSAVYRG | 1128 | YSGRSAVY | 1202 | TSYTGRSAVVAG | 1254 | TSYTGRSAVVSG |
| 820 | TSYSGRSAVVRG | 1129 | YSGRSAVV | 1203 | TSYTGRSAVHAG | 1255 | TSYTGRSAVHSG |
| 821 | TSYSGRSAVHRG | 1130 | YSGRSAVH | 1204 | TSYSGRSAVPHG | 1256 | ISYSGRSAVPIG |
| 822 | TSYTGRSAVYRG | 1131 | YTGRSAVY | 1205 | TSPSGRSANIHG | 1257 | ISPSGRSANIIG |
| 823 | TSYTGRSAVVRG | 1132 | YTGRSAVV | 1206 | TSPSGRSANFHG | 1258 | ISPSGRSANFIG |

TABLE 1-continued

Protease Cleavage Sequences
(cleavable by uPA and MT-SP1)

| SEQ ID NO | Cleavage sequence | SEQ ID NO | Cleavage sequence |
|---|---|---|---|
| 1207 | TSPTGRSANPHG | 1259 | ISPTGRSANPIG |
| 1208 | TSPSGRSAIPHG | 1260 | ISPSGRSAIPIG |
| 1209 | TSYTGRSANPHG | 1261 | ISYTGRSANPIG |
| 1210 | TSYSGRSAIPHG | 1262 | ISYSGRSAIPIG |
| 1211 | TSISGRSANYHG | 1263 | ISISGRSANYIG |
| 1212 | TSPSGRSAGPHG | 1264 | ISPSGRSAGPIG |
| 1213 | TSYTGRSAVPHG | 1265 | ISYTGRSAVPIG |
| 1214 | TSYTGRSAVYHG | 1266 | ISYTGRSAVYIG |
| 1215 | TSYTGRSAVVHG | 1267 | ISYTGRSAVVIG |
| 1216 | TSYTGRSAVHHG | 1268 | ISYTGRSAVHIG |
| 1217 | TSYSGRSAVPIG | 1269 | YSYSGRSAVPIG |
| 1218 | TSPSGRSANIIG | 1270 | YSPSGRSANIIG |
| 1219 | TSPSGRSANFIG | 1271 | YSPSGRSANFIG |
| 1220 | TSPTGRSANPIG | 1272 | YSPTGRSANPIG |
| 1221 | TSPSGRSAIPIG | 1273 | YSPSGRSAIPIG |
| 1222 | TSYTGRSANPIG | 1274 | YSYTGRSANPIG |
| 1223 | TSYSGRSAIPIG | 1275 | YSYSGRSAIPIG |
| 1224 | TSISGRSANYIG | 1276 | YSISGRSANYIG |
| 1225 | TSPSGRSAGPIG | 1277 | YSPSGRSAGPIG |
| 1226 | TSYTGRSAVPIG | 1278 | YSYTGRSAVPIG |
| 1227 | TSYTGRSAVYIG | 1279 | YSYTGRSAVYIG |
| 1228 | TSYTGRSAVVIG | 1280 | YSYTGRSAVVIG |
| 1229 | TSYTGRSAVHIG | 1281 | YSYTGRSAVHIG |
| 1230 | TSYSGRSAVPLG | 1382 | TSYTGRSAVPRG |
| 1231 | TSPSGRSANILG | 1383 | TSYSGRSAVVRG |
| 1232 | TSPSGRSANFLG | 1384 | TSYTGRSAVYRG |
| 1233 | TSPTGRSANPLG | 1385 | TSYTGRSAVHRG |
| 1234 | TSPSGRSAIPLG | | |

The following sequence may also be used as a protease cleavage sequence: X1-X2-X3-X4-X5-X6-X7-X8 (SEQ ID NO: 1161)
wherein, X1 to X8 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; and X8 is an amino acid selected from A, D, E, F, G, H, I, K, L, M, N, P, Q, R, S, T, V, W and Y.

The following sequence may also be used as a protease cleavage sequence: X1-X2-X3-X4-X5-X6-X7-X8 (SEQ ID NO: 1162)
wherein, X1 to X8 each represent a single amino acid, X1 is an amino acid selected from A, E, F, G, H, K, M, N, P, Q, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y.

The following sequence may also be used as a protease cleavage sequence: X1-X2-X3-X4-X5-X6-X7-X8 (SEQ ID NO: 1163)
wherein, X1 to X8 each represent a single amino acid, X1 is an amino acid selected from A, D, E, F, G, H, I, K, M, N, P, Q, S, T, W and Y; X2 is an amino acid selected from A, D, F, L, M, P, Q, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y.

The following sequence may also be used as a protease cleavage sequence: X1-X2-X3-X4-X5-X6-X7-X8 (SEQ ID NO: 1164)
wherein, X1 to X8 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, E, F, H, I, K, L, M, N, P, Q, R, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y.

The following sequence may also be used as a protease cleavage sequence: X1-X2-X3-X4-X5-X6-X7-X8 (SEQ ID NO: 1165)
wherein, X1 to X8 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, G, H, I, K, L, M, N, Q, R, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y.

The following sequence may also be used as a protease cleavage sequence: X1-X2-X3-X4-X5-X6-X7-X8 (SEQ ID NO: 1166)
wherein, X1 to X8 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from E, F, K, M, N, P, Q, R, S and W; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y.

The following sequence may also be used as a protease cleavage sequence: X1-X2-X3-X4-X5-X6-X7-X8 (SEQ ID NO: 1167)

wherein, X1 to X8 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, F, G, L, M, P, Q, V and W; X8 is an amino acid selected from A, D, E, F, G, H, I, K, L, M, N, P, Q, R, S, T, V, W and Y.

The following sequence may also be used as a protease cleavage sequence: X1-X2-X3-X4-X5-X6-X7-X8 (SEQ ID NO: 1168)

wherein, X1 to X8 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, I, K, N, T and W.

The following sequence may also be used as a protease cleavage sequence: X1-X2-X3-X4-X5-X6-X7-X8 (SEQ ID NO: 1169)

wherein, X1 to X8 each represent a single amino acid, X1 is an amino acid selected from A, G, I, P, Q, S and Y; X2 is an amino acid selected from K or T; X3 is G; X4 is R; X5 is S; X6 is A; X7 is an amino acid selected from H, I and V; X8 is an amino acid selected from H, V and Y.

The following sequence may also be used as a protease cleavage sequence: X1-X2-X3-X4-X5-X6-X7-X8 (SEQ ID NO: 1170)

wherein, X1 to X8 each represent a single amino acid, X1 is Y; X2 is an amino acid selected from S and T; X3 is G; X4 is R; X5 is S; X6 is an amino acid selected from A and E; X7 is an amino acid selected from N and V; X8 is an amino acid selected from H, P, V and Y.

The following sequence may also be used as a protease cleavage sequence: X1-X2-X3-X4-X5-X6-X7-X8-X9 (SEQ ID NO: 1171)

wherein, X1 to X9 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; X9 is an amino acid selected from A, G, H, I, L and R.

The following sequence may also be used as a protease cleavage sequence: X1-X2-X3-X4-X5-X6-X7-X8-X9 (SEQ ID NO: 1172)

wherein, X1 to X9 each represent a single amino acid, X1 is an amino acid selected from A, E, F, G, H, K, M, N, P, Q, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; X9 is an amino acid selected from A, G, H, I, L and R.

The following sequence may also be used as a protease cleavage sequence: X1-X2-X3-X4-X5-X6-X7-X8-X9 (SEQ ID NO: 1173)

wherein, X1 to X9 each represent a single amino acid, X1 is an amino acid selected from A, D, E, F, G, H, I, K, M, N, P, Q, S, T, W and Y; X2 is an amino acid selected from A, D, F, L, M, P, Q, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; X9 is an amino acid selected from A, G, H, I, L and R.

The following sequence may also be used as a protease cleavage sequence: X1-X2-X3-X4-X5-X6-X7-X8-X9 (SEQ ID NO: 1174)

wherein, X1 to X9 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, E, F, H, I, K, L, M, N, P, Q, R, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; X9 is an amino acid selected from A, G, H, I, L and R.

The following sequence may also be used as a protease cleavage sequence: X1-X2-X3-X4-X5-X6-X7-X8-X9 (SEQ ID NO: 1175)

wherein, X1 to X9 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, G, H, I, K, L, M, N, Q, R, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; X9 is an amino acid selected from A, G, H, I, L and R.

The following sequence may also be used as a protease cleavage sequence: X1-X2-X3-X4-X5-X6-X7-X8-X9 (SEQ ID NO: 1176)

wherein, X1 to X9 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from E, F, K, M, N, P, Q, R, S and W; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; X9 is an amino acid selected from A, G, H, I, L and R.

The following sequence may also be used as a protease cleavage sequence: X1-X2-X3-X4-X5-X6-X7-X8-X9 (SEQ ID NO: 1177)

wherein, X1 to X9 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, F, G, L, M, P, Q, V and W; X8 is an amino acid selected from A, D, E, F, G, H, I, K, L, M, N, P, Q, R, S, T, V, W and Y; X9 is an amino acid selected from A, G, H, I, L and R.

The following sequence may also be used as a protease cleavage sequence: X1-X2-X3-X4-X5-X6-X7-X8-X9 (SEQ ID NO: 1178)

wherein, X1 to X9 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, I, K, N, T and W; X9 is an amino acid selected from A, G, H, I, L and R.

The following sequence may also be used as a protease cleavage sequence: X1-X2-X3-X4-X5-X6-X7-X8-X9 (SEQ ID NO: 1179)

wherein, X1 to X9 each represent a single amino acid, X1 is an amino acid selected from A, G, I, P, Q, S and Y; X2 is an amino acid selected from K or T; X3 is G; X4 is R; X5 is S; X6 is A; X7 is an amino acid selected from H, I and V; X8 is an amino acid selected from H, V and Y; X9 is an amino acid selected from A, G, H, I, L and R.

The following sequence may also be used as a protease cleavage sequence: X1-X2-X3-X4-X5-X6-X7-X8-X9 (SEQ ID NO: 1180)

wherein, X1 to X9 each represent a single amino acid, X1 is Y; X2 is an amino acid selected from S and T; X3 is G; X4 is R; X5 is S; X6 is an amino acid selected from A and E; X7 is an amino acid selected from N and V; X8 is an amino acid selected from H, P, V and Y; X9 is an amino acid selected from A, G, H, I, L and R.

The following sequence may also be used as a protease cleavage sequence: X10-X11-X1-X2-X3-X4-X5-X6-X7-X8 (SEQ ID NO: 1392)

wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y.

The following sequence may also be used as a protease cleavage sequence: X10-X11-X1-X2-X3-X4-X5-X6-X7-X8 (SEQ ID NO: 1393)

wherein, X1 to X11 each represent a single amino acid, X10 is an amino acid selected from I, T and Y; X11 is S; X1 is an amino acid selected from A, E, F, G, H, K, M, N, P, Q, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y.

The following sequence may also be used as a protease cleavage sequence: X10-X11-X1-X2-X3-X4-X5-X6-X7-X8 (SEQ ID NO: 1394)

wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, F, L, M, P, Q, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y.

The following sequence may also be used as a protease cleavage sequence: X10-X11-X1-X2-X3-X4-X5-X6-X7-X8 (SEQ ID NO: 1395)

wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, E, F, H, I, K, L, M, N, P, Q, R, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y.

The following sequence may also be used as a protease cleavage sequence: X10-X11-X1-X2-X3-X4-X5-X6-X7-X8 (SEQ ID NO: 1396)

wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, G, H, I, K, L, M, N, Q, R, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y.

The following sequence may also be used as a protease cleavage sequence: X10-X11-X1-X2-X3-X4-X5-X6-X7-X8 (SEQ ID NO: 1397)

wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from E, F, K, M, N, P, Q, R, S and W; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y.

The following sequence may also be used as a protease cleavage sequence: X10-X11-X1-X2-X3-X4-X5-X6-X7-X8 (SEQ ID NO: 1398)

wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, F, G, L, M, P, Q, V and W; X8 is an amino acid selected from A, D, E, F, G, H, I, K, L, M, N, P, Q, R, S, T, V, W and Y.

The following sequence may also be used as a protease cleavage sequence: X10-X11-X1-X2-X3-X4-X5-X6-X7-X8 (SEQ ID NO: 1399)

wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, I, K, N, T and W.

The following sequence may also be used as a protease cleavage sequence: X10-X11-X1-X2-X3-X4-X5-X6-X7-X8 (SEQ ID NO: 1400)

wherein, X1 to X11 each represent a single amino acid, X10 is an amino acid selected from I, T and Y; X11 is S; X1 is an amino acid selected from A, G, I, P, Q, S and Y; X2 is an amino acid selected from K or T; X3 is G; X4 is R; X5 is S; X6 is A; X7 is an amino acid selected from H, I and V; X8 is an amino acid selected from H, V and Y.

The following sequence may also be used as a protease cleavage sequence: X10-X11-X1-X2-X3-X4-X5-X6-X7-X8 (SEQ ID NO: 1401)

wherein, X1 to X11 each represent a single amino acid, X10 is an amino acid selected from I, T and Y; X11 is S; X1 is Y; X2 is an amino acid selected from S and T; X3 is G; X4 is R; X5 is S; X6 is an amino acid selected from A and E; X7 is an amino acid selected from N and V; X8 is an amino acid selected from H, P, V and Y.

The following sequence may also be used as a protease cleavage sequence: X10-X11-X1-X2-X3-X4-X5-X6-X7-X8-X9 (SEQ ID NO: 1402)

wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; X9 is an amino acid selected from A, G, H, I, L and R.

The following sequence may also be used as a protease cleavage sequence: X10-X11-X1-X2-X3-X4-X5-X6-X7-X8-X9 (SEQ ID NO: 1403)

wherein, X1 to X11 each represent a single amino acid, X10 is an amino acid selected from I, T and Y; X11 is S; X1 is an amino acid selected from A, E, F, G, H, K, M, N, P, Q, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; X9 is an amino acid selected from A, G, H, I, L and R.

The following sequence may also be used as a protease cleavage sequence: X10-X11-X1-X2-X3-X4-X5-X6-X7-X8-X9 (SEQ ID NO: 1404)

wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, F, L, M, P, Q, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; X9 is an amino acid selected from A, G, H, I, L and R.

The following sequence may also be used as a protease cleavage sequence: X10-X11-X1-X2-X3-X4-X5-X6-X7-X8-X9 (SEQ ID NO: 1405)

wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, E, F, H, I, K, L, M, N, P, Q, R, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; X9 is an amino acid selected from A, G, H, I, L and R.

The following sequence may also be used as a protease cleavage sequence: X10-X11-X1-X2-X3-X4-X5-X6-X7-X8-X9 (SEQ ID NO: 1406)

wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, G, H, I, K, L, M, N, Q, R, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; X9 is an amino acid selected from A, G, H, I, L and R.

The following sequence may also be used as a protease cleavage sequence: X10-X11-X1-X2-X3-X4-X5-X6-X7-X8-X9 (SEQ ID NO: 1407)

wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from E, F, K, M, N, P, Q, R, S and W; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; X9 is an amino acid selected from A, G, H, I, L and R.

The following sequence may also be used as a protease cleavage sequence: X10-X11-X1-X2-X3-X4-X5-X6-X7-X8-X9 (SEQ ID NO: 1408)

wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, F, G, L, M, P, Q, V and W; X8 is an amino acid selected from A, D, E, F, G, H, I, K, L, M, N, P, Q, R, S, T, V, W and Y; X9 is an amino acid selected from A, G, H, I, L and R.

The following sequence may also be used as a protease cleavage sequence: X10-X11-X1-X2-X3-X4-X5-X6-X7-X8-X9 (SEQ ID NO: 1409)

wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, I, K, N, T and W; X9 is an amino acid selected from A, G, H, I, L and R.

The following sequence may also be used as a protease cleavage sequence: X10-X11-X1-X2-X3-X4-X5-X6-X7-X8-X9 (SEQ ID NO: 1410)

wherein, X1 to X11 each represent a single amino acid, X10 is an amino acid selected from I, T and Y; X11 is S; X1 is an amino acid selected from A, G, I, P, Q, S and Y; X2 is an amino acid selected from K or T; X3 is G; X4 is R; X5 is S; X6 is A; X7 is an amino acid selected from H, I and V; X8 is an amino acid selected from H, V and Y; X9 is an amino acid selected from A, G, H, I, L and R.

The following sequence may also be used as a protease cleavage sequence: X10-X11-X1-X2-X3-X4-X5-X6-X7-X8-X9 (SEQ ID NO: 1411)

wherein, X1 to X11 each represent a single amino acid, X10 is an amino acid selected from I, T and Y; X11 is S; X1 is Y; X2 is an amino acid selected from S and T; X3 is G; X4 is R; X5 is S; X6 is an amino acid selected from A and E; X7 is an amino acid selected from N and V; X8 is an amino acid selected from H, P, V and Y; X9 is an amino acid selected from A, G, H, I, L and R.

In addition to using the above-mentioned protease cleavage sequences, novel protease cleavage sequences may also be obtained by screening. For example, based on the result of crystal structure analysis of a known protease cleavage sequence, novel protease cleavage sequences can be explored by changing the interaction of active residues/recognition residues of the cleavage sequence and the enzyme. Novel protease cleavage sequences can also be explored by altering amino acids in a known protease cleavage sequence and examining interaction between the altered sequence and the protease. As another example, protease cleavage sequences can be explored by examining interaction of the protease with a library of peptides displayed using an in vitro display method such as phage display and ribosome display, or with an array of peptides immobilized on a chip or beads.

Interaction between a protease cleavage sequence and a protease can be examined by testing cleavage of the sequence by the protease in vitro or in vivo.

Cleavage fragments after protease treatment can be separated by electrophoresis such as SDS-PAGE and quantified to evaluate the protease cleavage sequence, the activity of the protease, and the cleavage ratio of a molecule into which the protease cleavage sequence has been introduced. A non-limiting embodiment of the method of evaluating the cleavage ratio of a molecule into which a protease cleavage sequence has been introduced includes the following method: For example, when the cleavage ratio of an antibody variant into which a protease cleavage sequence has been introduced is evaluated using recombinant human u-Plasminogen Activator/Urokinase (human uPA, huPA) (R&D Systems; 1310-SE-010) or recombinant human Matriptase/ST14 Catalytic Domain (human MT-SP1, hMT-SP1) (R&D Systems; 3946-SE-010), 100 μg/mL of the antibody variant is reacted with 40 nM huPA or 3 nM hMT-SP1 in PBS at 37° C. for one hour, and then subjected to capillary electrophoresis immunoassay. Capillary electrophoresis immunoassay can be performed using Wes (Protein Simple), but the present method is not limited thereto. As an alternative to capillary electrophoresis immunoassay, SDS-PAGE and such may be performed for separation, followed by detection with Western blotting. The present method is not limited to these methods. Before and after cleavage, the light chain can be detected using anti-human lambda chain HRP-labeled antibody (abcam; ab9007), but any antibody that can detect cleavage fragments may be used. The area of each peak obtained after protease treatment is output using software for Wes (Compass for SW; Protein Simple), and the cleavage ratio (%) of the antibody variant can be determined with the following formula:

(Peak area of cleaved light chain)×100/(Peak area of cleaved light chain+Peak area of uncleaved light chain)

Cleavage ratios can be determined if protein fragments are detectable before and after protease treatment. Cleavage ratios can be determined not only for antibody variants but also for various protein molecules into which a protease cleavage sequence has been introduced.

The in vivo cleavage ratio of a molecule into which a protease cleavage sequence has been introduced can be determined by administering the molecule into animals and detecting the administered molecule in blood samples. For example, an antibody variant into which a protease cleavage sequence has been introduced is administered to mice, and plasma is collected from their blood samples. The antibody is purified from the plasma by a method known to those skilled in the art using Dynabeads Protein A (Thermo; 10001D), and then subjected to capillary electrophoresis immunoassay to evaluate the protease cleavage ratio of the antibody variant. Capillary electrophoresis immunoassay can be performed using Wes (Protein Simple), but the present method is not limited thereto. As an alternative to capillary electrophoresis immunoassay, SDS-PAGE and such may be performed for separation, followed by detection with Western blotting. The present method is not limited to these methods. The light chain of the antibody variant collected from mice can be detected using anti-human lambda chain HRP-labeled antibody (abcam; ab9007), but any antibody that can detect cleavage fragments may be used. Once the area of each peak obtained by capillary electrophoresis immunoassay is output using software for Wes (Compass for SW; Protein Simple), the ratio of the remaining light chain can be calculated as [Peak area of light chain]/[Peak area of heavy chain] to determine the ratio of the full-length light chain that remain uncleaved in the mouse body. In vivo cleavage efficiencies can be determined if protein fragments collected from a living organism are detectable. Cleavage ratios can be determined not only for antibody variants but also for various protein molecules into which a protease cleavage sequence has been introduced. Calculation of cleavage ratios by the above-mentioned methods enables, for example, comparison of the in vivo cleavage ratios of antibody variants into which different cleavage sequences have been introduced, and comparison of the cleavage ratio of a single antibody variant between different animal models such as a normal mouse model and a tumor-transplanted mouse model.

For example, the protease cleavage sequences shown in Table 1 have all been newly discovered by the present inventors. Polypeptides containing these protease cleavage sequences are all useful as protease substrates which are hydrolyzed by the action of proteases. Thus, the present invention provides protease substrates comprising a sequence selected from SEQ ID NOs: 1161-1180, 1392-1411, and the sequences listed in Table 1. The protease substrates of the present invention can be utilized as, for example, a library from which one with properties that suit the purpose can be selected to incorporate into a ligand-binding molecule. Specifically, in order to cleave the ligand-binding molecule selectively by a protease localized in the lesion, the substrates can be evaluated for sensitivity to that protease. When a ligand-binding molecule bound with a ligand is administered in vivo, the molecule may come in contact with various proteases before reaching the lesion. Therefore, the molecule should preferably have sensitivity to the protease localized to the lesion and also as high resistance as possible to the other proteases. In order to select a desired protease cleavage sequence depending on the purpose, each protease substrate can be analyzed in advance for sensitivity to various proteases comprehensively to find its protease resistance. Based on the obtained protease resistance spectra, it is possible to find a protease cleavage sequence with necessary sensitivity and resistance.

Alternatively, a ligand-binding molecule into which a protease cleavage sequence has been incorporated undergoes not only enzymatic actions by proteases but also various environmental stresses such as pH changes, temperature, and oxidative/reductive stress, before reaching the lesion. Based on the comparative information about resistance to these external factors among the protease substrates, protease cleavage sequence with desired properties can be selected.

In one embodiment of the present invention, a flexible linker is further attached to one end or both ends of the protease cleavage sequence. The flexible linker at one end of the protease cleavage sequence can be referred to as "first flexible linker", and the flexible linker at the other end can be referred to as "second flexible linker". In a particular embodiment, the protease cleavage sequence and the flexible linker have any of the following formulas:
(protease cleavage sequence),
(first flexible linker)-(protease cleavage sequence),
(protease cleavage sequence)-(second flexible linker), and
(first flexible linker)-(protease cleavage sequence)-(second flexible linker).

The flexible linker according to the present embodiment is preferably a peptide linker. The first flexible linker and the second flexible linker each exist independently and arbitrarily and are identical or different flexible linkers containing at least one flexible amino acid (Gly, etc.). The flexible linker contains, for example, number of residues (amino acids arbitrarily selected from Arg, Ile, Gln, Glu, Cys, Tyr, Trp, Thr, Val, His, Phe, Pro, Met, Lys, Gly, Ser, Asp, Asn, Ala, etc., particularly Gly, Ser, Asp, Asn, and Ala, more particularly, Gly and Ser, especially Gly, etc.) sufficient for the protease cleavage sequence to obtain the desired protease accessibility.

The flexible linker suitable for use at both ends of the protease cleavage sequence is usually a flexible linker that improves the access of protease to the protease cleavage sequence and elevates the cleavage efficiency of the protease. A suitable flexible linker may be readily selected and can be preferably selected from among different lengths such as 1 amino acid (Gly, etc.) to 20 amino acids, 2 amino acids to 15 amino acids, or 3 amino acids to 12 amino acids including 4 amino acids to 10 amino acids, 5 amino acids to 9 amino acids, 6 amino acids to 8 amino acids, or 7 amino acids to 8 amino acids. In some embodiments of the present invention, the flexible linker is a peptide linker of 1 to 7 amino acids.

Examples of the flexible linker include, but are not limited to, glycine polymers (G)n, glycine-serine polymers (including e.g., (GS)n, (GSGGS: SEQ ID NO: 45)n, and (GGGS: SEQ ID NO: 36)n, wherein n is an integer of at least 1), glycine-alanine polymers, alanine-serine polymers, and other flexible linkers well known in conventional techniques. Among them, glycine and glycine-serine polymers are receiving attention because these amino acids are relatively unstructured and can easily function as neutral tethers between components.

Examples of the flexible linker consisting of the glycine-serine polymer can include, but are not limited to,
Ser
Gly·Ser (GS)
Ser·Gly (SG)
Gly·Gly·Ser (GGS)
Gly·Ser·Gly (GSG)
Ser·Gly·Gly (SGG)
Gly·Ser·Ser (GSS)
Ser·Ser·Gly (SSG)
Ser·Gly·Ser (SGS)
Gly·Gly·Gly·Ser (GGGS, SEQ ID NO: 36)
Gly·Gly·Ser·Gly (GGSG, SEQ ID NO: 37)
Gly·Ser·Gly·Gly (GSGG, SEQ ID NO: 38)
Ser·Gly·Gly·Gly (SGGG, SEQ ID NO: 39)
Gly·Ser·Ser·Gly (GSSG, SEQ ID NO: 40)
Gly·Gly·Gly·Gly·Ser (GGGGS, SEQ ID NO: 41)
Gly·Gly·Gly·Ser·Gly (GGGSG, SEQ ID NO: 42)
Gly·Gly·Ser·Gly·Gly (GGSGG, SEQ ID NO: 43)
Gly·Ser·Gly·Gly·Gly (GSGGG, SEQ ID NO: 44)
Gly·Ser·Gly·Gly·Ser (GSGGS, SEQ ID NO: 45)
Ser·Gly·Gly·Gly·Gly (SGGGG, SEQ ID NO: 46)
Gly·Ser·Ser·Gly·Gly (GSSGG, SEQ ID NO: 47)
Gly·Ser·Gly·Ser·Gly (GSGSG, SEQ ID NO: 48)
Ser·Gly·Gly·Ser·Gly (SGGSG, SEQ ID NO: 49)
Gly·Ser·Ser·Ser·Gly (GSSSG, SEQ ID NO: 50)
Gly·Gly·Gly·Gly·Gly·Ser (GGGGGS, SEQ ID NO: 51)
Ser·Gly·Gly·Gly·Gly·Gly (SGGGGG, SEQ ID NO: 52)
Gly·Gly·Gly·Gly·Gly·Gly·Ser (GGGGGGS, SEQ ID NO: 53)
Ser·Gly·Gly·Gly·Gly·Gly·Gly (SGGGGGG, SEQ ID NO: 54)
(Gly·Gly·Gly·Gly·Ser (GGGGS, SEQ ID NO: 41))n
(Ser·Gly·Gly·Gly·Gly (SGGGG, SEQ ID NO: 46))n
wherein n is an integer of 1 or larger.
However, the length and sequence of the peptide linker can be appropriately selected by those skilled in the art according to the purpose.

In some embodiments of the present invention, the ligand-binding molecule comprises antibody VH and antibody VL. Examples of the ligand-binding molecule comprising VH and VL include, but are not limited to, Fv, scFv, Fab, Fab', Fab'-SH, F(ab')2, and complete antibodies.

In some embodiments of the present invention, the ligand-binding molecule comprises an Fc region. In the case of using an IgG antibody Fc region, its type is not limited, and for example, Fc region of IgG1, IgG2, IgG3, or IgG4 may be used. For example, an Fc region comprising one sequence selected from the amino acid sequences represented by SEQ ID NOs: 55, 56, 57, and 58, or an Fc region mutant prepared by adding an alteration to the Fc regions may be used. In some embodiments of the present invention, the ligand-binding molecule comprises an antibody constant region.

In several more specific embodiments of the present invention, the ligand-binding molecule is an antibody. In the case of using an antibody as the ligand-binding molecule, the binding to the ligand is achieved by a variable region. In some further specific embodiments, the ligand-binding molecule is an IgG antibody. In the case of using an IgG antibody as the ligand-binding molecule, its type is not limited, and IgG1, IgG2, IgG3, IgG4, or the like can be used. In the case of using an IgG antibody as the ligand-binding molecule, the binding to the ligand is also achieved by a variable region. One or both of the two variable regions of the IgG antibody can achieve the binding to the ligand.

In some embodiments of the present invention, a domain having ligand binding activity in the ligand-binding molecule is divided by the cleavage of the cleavage site/protease cleavage sequence in the ligand-binding molecule, and the binding to the ligand is attenuated. In the case of using an IgG antibody as the ligand-binding molecule, an exemplary embodiment includes placing the cleavage site/protease cleavage sequence in an antibody variable region and attenuating the binding to the ligand in a cleaved state by lack of ability to form a complete antibody variable region.

In the present specification, "association" can refer to, for example, a state where two or more polypeptide regions interact with each other. In general, a hydrophobic bond, a hydrogen bond, an ionic bond, or the like is formed between the intended polypeptide regions to form an associate. As one example of common association, an antibody represented by a natural antibody is known to retain a paired structure of a heavy chain variable region (VH) and a light chain variable region (VL) through a noncovalent bond or the like therebetween.

In some embodiments of the present invention, VH and VL contained in the ligand-binding molecule associate with each other. The association between antibody VH and antibody VL may be canceled, for example, by the cleavage of the cleavage site/protease cleavage sequence. Cancelation of association can refer to, for example, cancelation of a whole or part of the state where two or more polypeptide regions are interacting with each other. Cancelation of the association between VH and VL can include cancelation of the interaction between VH and VL as a whole, or cancelation of a part of the interaction between VH and VL.

The ligand-binding molecule of the present invention encompasses a ligand-binding molecule in which the association between antibody VL or a portion thereof and antibody VH or a portion thereof in the ligand-binding molecule is canceled by the cleavage of the cleavage site or canceled by the cleavage of the protease cleavage sequence by the protease.

In some embodiments of the present invention, the ligand-binding molecule comprises antibody VH and antibody VL, and the antibody VH and the antibody VL in the ligand-binding molecule are associated with each other in a state where the cleavage site or the protease cleavage sequence of the ligand-binding molecule is uncleaved, whereas the association between the antibody VH and the antibody VL in the ligand-binding molecule is canceled by the cleavage of the cleavage site or the protease cleavage sequence. The cleavage site or the protease cleavage sequence in the ligand-binding molecule may be placed at any position in the ligand-binding molecule as long as the binding of the ligand-binding molecule to the ligand can be attenuated by the cleavage of the cleavage site or the protease cleavage sequence.

In some embodiments of the present invention, the ligand-binding molecule comprises antibody VH, antibody VL, and an antibody constant region.

As mentioned by Rothlisberger et al. (J Mol Biol. 2005 Apr. 8; 347 (4): 773-89), it is known that the VH and VL domains or the CH and CL domains of an antibody interact with each other via many amino acid side chains. VH-CH1 and VL-CL are known to be capable of forming a stable structure as a Fab domain. As reported, amino acid side chains between VH and VL generally interact with a dissociation constant in the range of 10-5 M to 10-8 M. When only VH and VL domains exist, only a small proportion may form an associated state.

In some embodiments of the present invention, the ligand-binding molecule is designed such that the cleavage site or the protease cleavage sequence is provided in the ligand-binding molecule comprising antibody VH and antibody VL, and the entire heavy chain-light chain interaction is present between two peptides in the Fab structure before cleavage, whereas the interaction between the peptide containing the VH (or a portion of the VH) and the peptide containing the VL (or a portion of the VL) is attenuated by the cleavage of the cleavage site or the protease cleavage sequence so that the association between the VH and the VL is canceled.

In one embodiment of the present invention, the cleavage site or the protease cleavage sequence is located within the antibody constant region. In a more specific embodiment, the cleavage site or the protease cleavage sequence is located on the variable region side with respect to amino acid position 140 (EU numbering) in an antibody heavy chain constant region, preferably on the variable region side with respect to amino acid position 122 (EU numbering) in an antibody heavy chain constant region. In some specific embodiments, the cleavage site or the protease cleavage sequence is inserted into any position within the sequence from amino acid 118 in the antibody heavy chain constant region (EU numbering) to amino acid 140 in the antibody heavy chain constant region (EU numbering). In another more specific embodiment, the cleavage site or the protease cleavage sequence is located on the variable region side with respect to amino acid position 130 (EU numbering) (Kabat numbering position 130) in an antibody light chain constant region, preferably on the variable region side with respect to amino acid position 113 (EU numbering) (Kabat numbering position 113) in an antibody light chain constant region or on the variable region side with respect to amino acid position 112 (EU numbering) (Kabat numbering position 112) in an antibody light chain constant region. In some specific embodiments, the cleavage site or the protease cleavage sequence is inserted into any position within the sequence from amino acid 108 in the antibody light chain constant region (EU numbering) (Kabat numbering position 108) to amino acid 131 in the antibody light chain constant region (EU numbering) (Kabat numbering position 131).

In one embodiment of the present invention, the cleavage site or the protease cleavage sequence is located within the antibody VH or within the antibody VL. In a more specific embodiment, the cleavage site or the protease cleavage sequence is located on the antibody constant region side with respect to amino acid position 7 (Kabat numbering) of the antibody VH, preferably on the antibody constant region side with respect to amino acid position 40 (Kabat numbering) of the antibody VH, more preferably on the antibody constant region side with respect to amino acid position 101 (Kabat numbering) of the antibody VH, further preferably on the antibody constant region side with respect to amino acid position 109 (Kabat numbering) of the antibody VH or on the antibody constant region side with respect to amino acid position 111 (Kabat numbering) of the antibody VH. In a more specific embodiment, the cleavage site or the protease cleavage sequence is located on the antibody constant region side with respect to amino acid position 7 (Kabat numbering) of the antibody VL, preferably on the antibody constant region side with respect to amino acid position 39 (Kabat numbering) of the antibody VL, more preferably on the antibody constant region side with respect to amino acid position 96 (Kabat numbering) of the antibody VL, further preferably on the antibody constant region side with respect to amino acid position 104 (Kabat numbering) of the antibody VL or on the antibody constant region side with respect to amino acid position 105 (Kabat numbering) of the antibody VL.

In some more specific embodiments, the cleavage site or the protease cleavage sequence is inserted at a position of residues forming a loop structure in the antibody VH or the antibody VL, and residues close to the loop structure. The loop structure in the antibody VH or the antibody VL refers to a portion that does not form a secondary structure such as α-helix or β-sheet, in the antibody VH or the antibody VL. Specifically, the position of the residues forming the loop structure and the residues close to the loop structure can refer to the range of amino acid position 7 (Kabat numbering) to amino acid position 16 (Kabat numbering), amino acid position 40 (Kabat numbering) to amino acid position 47 (Kabat numbering), amino acid position 55 (Kabat numbering) to amino acid position 69 (Kabat numbering), amino acid position 73 (Kabat numbering) to amino acid position 79 (Kabat numbering), amino acid position 83 (Kabat numbering) to amino acid position 89 (Kabat numbering), amino acid position 95 (Kabat numbering) to amino acid position 99 (Kabat numbering), or amino acid position 101 (Kabat numbering) to amino acid position 113 (Kabat numbering) of the antibody VH, or amino acid position 7 (Kabat numbering) to amino acid position 19 (Kabat numbering), amino acid position 39 (Kabat numbering) to amino acid position 46 (Kabat numbering), amino acid position 49 (Kabat numbering) to amino acid position 62 (Kabat numbering), or amino acid position 96 (Kabat numbering) to amino acid position 107 (Kabat numbering) of the antibody VL.

In some more specific embodiments, the cleavage site or the protease cleavage sequence is inserted at any position in a sequence from amino acid position 7 (Kabat numbering) to amino acid position 16 (Kabat numbering), from amino acid position 40 (Kabat numbering) to amino acid position 47 (Kabat numbering), from amino acid position 55 (Kabat numbering) to amino acid position 69 (Kabat numbering), from amino acid position 73 (Kabat numbering) to amino acid position 79 (Kabat numbering), from amino acid position 83 (Kabat numbering) to amino acid position 89 (Kabat numbering), from amino acid position 95 (Kabat numbering) to amino acid position 99 (Kabat numbering), or from amino acid position 101 (Kabat numbering) to amino acid position 113 (Kabat numbering) of the antibody VH.

In some more specific embodiments, the cleavage site or the protease cleavage sequence is inserted at any position in a sequence from amino acid position 7 (Kabat numbering) to amino acid position 19 (Kabat numbering), from amino acid position 39 (Kabat numbering) to amino acid position 46 (Kabat numbering), from amino acid position 49 (Kabat numbering) to amino acid position 62 (Kabat numbering), or from amino acid position 96 (Kabat numbering) to amino acid position 107 (Kabat numbering) of the antibody VL.

In one embodiment of the present invention, the cleavage site or the protease cleavage sequence is located near the boundary between the antibody VH and the antibody constant region. The phrase "near the boundary between the antibody VH and the antibody heavy chain constant region" can refer to between amino acid position 101 (Kabat numbering) of the antibody VH and amino acid position 140 (EU numbering) of the antibody heavy chain constant region and can preferably refer to between amino acid position 109 (Kabat numbering) of the antibody VH and amino acid position 122 (EU numbering) of the antibody heavy chain constant region, or between amino acid position 111 (Kabat numbering) of the antibody VH and amino acid position 122 (EU numbering) of the antibody heavy chain constant region. When antibody VH is linked to an antibody light chain constant region, the phrase "near the boundary between the antibody VH and the antibody light chain constant region" can refer to between amino acid position 101 (Kabat numbering) of the antibody VH and amino acid position 130 (EU numbering) (Kabat numbering position 130) of the antibody light chain constant region and can preferably refer to between amino acid position 109 (Kabat numbering) of the antibody VH and amino acid position 113 (EU numbering) (Kabat numbering position 113) of the antibody light chain constant region, or between amino acid position 111 (Kabat numbering) of the antibody VH and amino acid position 112 (EU numbering) (Kabat numbering position 112) of the antibody light chain constant region.

In one embodiment, the cleavage site or the protease cleavage sequence is located near the boundary between the antibody VL and the antibody constant region. The phrase "near the boundary between the antibody VL and the antibody light chain constant region" can refer to between amino acid position 96 (Kabat numbering) of the antibody VL and amino acid position 130 (EU numbering) (Kabat numbering position 130) of the antibody light chain constant region and can preferably refer to between amino acid position 104 (Kabat numbering) of the antibody VL and amino acid position 113 (EU numbering) (Kabat numbering position 113) of the antibody light chain constant region, or between amino acid position 105 (Kabat numbering) of the antibody VL and amino acid position 112 (EU numbering) (Kabat numbering position 112) of the antibody light chain constant region. When antibody VL is linked to an antibody heavy chain constant region, the phrase "near the boundary between the antibody VL and the antibody heavy chain constant region" can refer to between amino acid position 96 (Kabat numbering) of the antibody VL and amino acid position 140 (EU numbering) of the antibody heavy chain constant region and can preferably refer to between amino acid position 104 (Kabat numbering) of the antibody VL and amino acid position 122 (EU numbering) of the antibody heavy chain constant region, or between amino acid position 105 (Kabat numbering) of the antibody VL and amino acid position 122 (EU numbering) of the antibody heavy chain constant region.

The cleavage site or the protease cleavage sequence can be provided at a plurality of positions in the ligand-binding molecule, for example, at a plurality of positions selected from: within the antibody constant region, within the antibody VH, within the antibody VL, near the boundary between the antibody VH and the antibody constant region, and near the boundary between antibody VL and the antibody constant region. Those skilled in the art who referred to the present invention can change the form of a molecule comprising antibody VH, antibody VL, and an antibody constant region, for example, by swapping the antibody VH with the antibody VL. Such a molecular form does not depart from the scope of the present invention.

In the present specification, the term "ligand" is a molecule having biological activity. The molecule having biological activity usually functions by interacting with a receptor on cell surface and thereby performing biological stimulation, inhibition, or modulation in other modes. These functions are usually thought to participate in the intracellular signaling pathways of cells carrying the receptor.

In the present specification, the ligand encompasses a desired molecule that exerts biological activity through interaction with a biomolecule. For example, the ligand not only means a molecule that interacts with a receptor but also includes a molecule that exerts biological activity through interaction with the molecule, such as a receptor that interacts with the molecule, or a binding fragment thereof. For example, a ligand binding site of a protein known as a receptor, and a protein containing a site of the receptor which interacts with another molecule are included in the ligand according to the present invention. Specifically, a soluble receptor, a soluble fragment of a receptor, an extracellular domain of a transmembrane receptor, and polypeptides containing them and such are included in the ligand according to the present invention.

The ligand of the present invention can usually exert desirable biological activity by binding to one or more binding partners. The binding partner of the ligand can be an extracellular, intracellular, or transmembrane protein. In one embodiment, the binding partner of the ligand is an extracellular protein, for example, a soluble receptor. In another embodiment, the binding partner of the ligand is a membrane-bound receptor. The ligand of the present invention can specifically bind to the binding partner with a dissociation constant (KD) of 10 µM, 1 µM, 100 nM, 50 nM, 10 nM, 5 nM, 1 nM, 500 pM, 400 pM, 350 pM, 300 pM, 250 pM, 200 pM, 150 pM, 100 pM, 50 pM, 25 pM, 10 pM, 5 pM, 1 pM, 0.5 pM, or 0.1 pM or less.

Examples of the molecule having biological activity include, but are not limited to, cytokines, chemokines, polypeptide hormones, growth factors, apoptosis inducing factors, PAMPs, DAMPs, nucleic acids, and fragments thereof. In a specific embodiment, an interleukin, an interferon, a hematopoietic factor, a member of the TNF superfamily, a chemokine, a cell growth factor, a member of the TGF-β family, a myokine, an adipokine, or a neurotrophic factor can be used as the ligand. In a more specific embodiment, CXCL10, IL-2, IL-7, IL-12, IL-15, IL-18, IL-21, IFN-α, IFN-β, IFN-g, MIG, I-TAC, RANTES, MIP-1a, MIP-1b, IL-1R1 (Interleukin-1 receptor, type I), IL-1R2 (Interleukin-1 receptor, type II), IL-1RAcP (Interleukin-1 receptor accessory protein), or IL-1Ra (Protein Accession No. NP_776214, mRNA Accession No. NM_173842.2) can be used as the ligand.

Chemokines are a family of homogeneous serum proteins of 7 to 16 kDa originally characterized by their ability to induce leukocyte migration. Most of chemokines have four characteristic cysteines (Cys) and are classified into CXC or alpha, CC or beta, C or gamma and CX3C or delta chemokine classes, according to motifs displayed by the first two cysteines. Two disulfide bonds are formed between the first and third cysteines and between the second and fourth cysteines. In general, the disulfide bridges are considered necessary. Clark-Lewis and collaborators have reported that the disulfide bonds are crucial for the chemokine activity of at least CXCL10 (Clark-Lewis et al., J. Biol. Chem. 269: 16075-16081, 1994). The only one exception to having four cysteines is lymphotactin, which has only two cysteine residues. Thus, lymphotactin narrowly maintains its functional structure by only one disulfide bond.

Subfamilies of CXC or alpha are further classified, according to the presence of an ELR motif (Glu-Leu-Arg) preceding the first cysteine, into two groups: ELR-CXC chemokines and non-ELR-CXC chemokines (see e.g., Clark-Lewis, supra; and Belperio et al., "CXC Chemokines in Angiogenesis", J. Leukoc. Biol. 68:1-8, 2000).

Interferon-inducible protein-10 (IP-10 or CXCL10) is induced by interferon-γ and TNF-α and produced by keratinocytes, endothelial cells, fibroblasts and monocytes. IP-10 is considered to play a role in mobilizing activated T cells to an inflammatory site of a tissue (Dufour, et al., "IFN-gamma-inducible protein 10 (IP-10; CXCL10)-deficient mice reveal a role for IP-10 in effector T cell generation and trafficking", J Immunol., 168:3195-204, 2002). Furthermore, there is a possibility that IP-10 plays a role in hypersensitive reaction. In addition, there is a possibility that IP-10 also plays a role in the occurrence of inflammatory demyelinating neuropathies (Kieseier, et al., "Chemokines and chemokine receptors in inflammatory demyelinating neuropathies: a central role for IP-10", Brain 125:823-34, 2002).

Researches indicate that IP-10 may be useful in the engraftment of stem cells following transplantation (Nagasawa, T., Int. J. Hematol. 72:408-11, 2000), in the mobilization of stem cells (Gazitt, Y., J. Hematother Stem Cell Res 10:229-36, 2001; and Hattori et al., Blood 97:3354-59, 2001) and in an enhancement of antitumor immunity (Nomura et al., Int. J. Cancer 91:597-606, 2001; and Mach and Dranoff, Curr. Opin. Immunol. 12:571-75, 2000). For example, previous reports known to those skilled in the art discuss the biological activity of chemokine (Bruce, L. et al., "Radiolabeled Chemokine binding assays", Methods in Molecular Biology (2000) vol. 138, pp. 129-134; Raphaele, B. et al., "Calcium Mobilization", Methods in Molecular Biology (2000) vol. 138, pp. 143-148; and Paul D. Ponath et al., "Transwell Chemotaxis", Methods in Molecular Biology (2000) vol. 138, pp. 113-120 Humana Press. Totowa, New Jersey).

Examples of the biological activity of CXCL10 include binding to a CXCL10 receptor (CXCR3), CXCL10-induced calcium flux, CXCL10-induced cellular chemotaxis, binding of CXCL10 to glycosaminoglycan and CXCL10 oligomerization. Examples of the method for measuring the physiological activity of CXCL10 include a method of measuring the cell migration activity of CXCL10, reporter assay using a cell line stably expressing CXCR3 (see PLOS One. 2010 Sep. 13; 5 (9): e12700), and PathHunter™ β-Arrestin recruitment assay using B-arrestin recruitment induced at the early stage of GPCR signal transduction.

Interleukin 12 (IL-12) is a heterodimeric cytokine consisting of disulfide-linked glycosylated polypeptide chains of 30 and 40 kD. Cytokines are synthesized by and then secreted from dendritic cells, monocytes, macrophages, B cells, Langerhans cells and keratinocytes, and antigen-presenting cells including natural killer (NK) cells. IL-12 mediates various biological processes and has been mentioned as a NK cell stimulatory factor (NKSF), a T cell stimulatory factor, a cytotoxic T lymphocyte maturation factor and an EBV-transformed B cell line factor.

Interleukin 12 can bind to an IL-12 receptor expressed on the cytoplasmic membranes of cells (e.g., T cells and NK cells) and thereby change (e.g., start or block) a biological process. For example, the binding of IL-12 to an IL-12 receptor stimulates the growth of preactivated T cells and NK cells, promotes the cytolytic activity of cytotoxic T cells (CTL), NK cells and LAK (lymphokine-activated killer) cells, induces the production of γ interferon (IFNγ) by T cells and NK cells, and induces the differentiation of naive Th0 cells into Th1 cells producing IFNγ and IL-2. In particular, IL-12 is absolutely necessary for setting the production and cellular immune response (e.g., Th1 cell-mediated immune response) of cytolytic cells (e.g., NK and CTL). Thus, IL-12 is absolutely necessary for generating and regulating both protective immunity (e.g., eradication of infectious disease) and pathological immune response (e.g., autoimmunity).

Examples of the method for measuring the physiological activity of IL-12 include a method of measuring the cell growth activity of IL-12, STAT4 reporter assay, a method of measuring cell activation (cell surface marker expression, cytokine production, etc.) by IL-12, and a method of measuring the promotion of cell differentiation by IL-12.

Programmed death 1 (PD-1) protein is an inhibitory member of the CD28 family of receptors. The CD28 family also includes CD28, CTLA-4, ICOS and BTLA. PD-1 is expressed on activated B cells, T cells and bone marrow cells (Okazaki et al., (2002) Curr. Opin. Immunol. 14:391779-82; and Bennett et al., (2003) J Immunol 170: 711-8). CD28 and ICOS, the initial members of the family, were discovered on the basis of functional influence on the elevation of T cell growth after monoclonal antibody addition (Hutloff et al., (1999) Nature 397:263-266; and Hansen et al., (1980) Immunogenics 10:247-260). PD-1 was discovered by screening for differential expression in apoptotic cells (Ishida et al., (1992) EMBO J 11:3887-95). CTLA-4 and BTLA, the other members of the family, were discovered by screening for differential expression in cytotoxic T lymphocytes and THI cells, respectively. CD28, ICOS and CTLA-4 all have an unpaired cysteine residue which permits homodimerization. In contrast, PD-1 is considered to exist as a monomer and lacks an unpaired cysteine residue characteristic of other members of the CD28 family.

The PD-1 gene encodes for a 55 kDa type I transmembrane protein which is part of the Ig gene superfamily. PD-1 contains a membrane-proximal immunoreceptor tyrosine inhibitory motif (ITIM) and a membrane-distal tyrosine-based switch motif (ITSM). PD-1 is structurally similar to CTLA-4, but lacks a MYPPPY motif (SEQ ID NO: 537) important for B7-1 and B7-2 binding. Two ligands for PD-1, PD-L1 and PD-L2, have been identified and have been shown to negatively regulate T-cell activation upon binding to PD-1 (Freeman et al., (2000) J Exp Med 192:1027-34; Latchman et al., (2001) Nat Immunol 2:261-8; and Carter et al., (2002) Eur J Immunol 32:634-43). Both PD-L1 and PD-L2 are B7 homologs that bind to PD-1, but do not bind to the other members of the CD28 family. PD-L1, one of the PD-1 ligands, is abundant in various human cancers (Dong et al., (2002) Nat. Med. 8:787-9). The interaction between PD-1 and PD-L1 results in decrease in tumor-infiltrating lymphocytes, reduction in T cell receptor-mediated growth, and immune evasion by the cancerous cells (Dong et al., (2003) J. Mol. Med. 81:281-7; Blank et al., (2005) Cancer Immunol. Immunother. 54:307-314; and Konishi et al., (2004) Clin. Cancer Res. 10:5094-100). Immunosuppression can be reversed by inhibiting the local interaction of PD-1 with PD-L1, and this effect is additive when the interaction of PD-2 with PD-L2 is also inhibited (Iwai et al., (2002) Proc. Natl. Acad. Sci. USA 99:12293-7; and Brown et al., (2003) J. Immunol. 170:1257-66).

PD-1 is an inhibitory member of the CD28 family expressed on activated B cells, T-cells, and bone marrow cells. Animals deficient in PD-1 develop various autoimmune phenotypes, including autoimmune cardiomyopathy and lupus-like syndrome with arthritis and nephritis (Nishimura et al., (1999) Immunity 11:141-51; and Nishimura et al., (2001) Science 291:319-22). PD-1 has been further found to play an important role in autoimmune encephalomyelitis, systemic lupus erythematosus, graft-versus-host disease (GVHD), type I diabetes mellitus, and rheumatoid arthritis (Salama et al., (2003) J Exp Med 198:71-78; Prokunia and Alarcon-Riquelme (2004) Hum Mol Genet 13: R143; and Nielsen et al., (2004) Lupus 13:510). In a mouse B cell tumor line, the ITSM of PD-1 has been shown to be essential for inhibiting BCR-mediated Ca2+ flux and tyrosine phosphorylation of downstream effector molecules (Okazaki et al., (2001) PNAS 98:13866-71).

In some embodiments of the present invention, the ligand is a cytokine. Cytokines are a secretory cell signaling protein family involved in immunomodulatory and inflammatory processes. These cytokines are secreted by glial cells of the nervous system and by many cells of the immune system. The cytokines can be classified into proteins, peptides and glycoproteins, and encompass large and diverse family of regulatory factors. The cytokines can induce intracellular signal transduction through binding to their cell surface receptors, thereby causing the regulation of enzyme activity, upregulation or downregulation of some genes and transcriptional factors thereof, or feedback inhibition, etc. In some embodiments, the cytokine of the present invention includes immunomodulatory factors such as interleukins (IL) and interferons (IFN). A suitable cytokine can contain a protein derived from one or more of the following types: four «-helix bundle families (which include the IL-2 subfamily, the IFN subfamily and IL-10 subfamily); the IL-1 family (which includes IL-1 and IL-8); and the IL-17 family. The cytokine can also include those classified into type 1 cytokines (e.g., IFN-γ and TGF-β) which enhance cellular immune response, or type 2 cytokines (e.g., IL-4, IL-10, and IL-13) which work advantageously for antibody reaction.

In some embodiments of the present invention, the ligand is a chemokine. Chemokines generally act as chemoattractants that mobilize immune effector cells to chemokine expression sites. This is considered beneficial for expressing a particular chemokine gene together with, for example, a cytokine gene, for the purpose of mobilizing other immune system components to a treatment site. Such chemokines include CXCL10, RANTES, MCAF, MIP1-α, and MIP1-β. Those skilled in the art should know that certain cytokines also have a chemoattractive effect and acknowledge that such cytokines can be classified by the term "chemokine".

In some embodiments of the present invention, a cytokine variant, a chemokine variant, or the like (e.g., Annu Rev Immunol. 2015; 33:139-67) or a fusion protein containing them (e.g., Stem Cells Transl Med. 2015 January; 4 (1): 66-73) can be used as the ligand.

In some embodiments of the present invention, the ligand is selected from CXCL10, PD-1, IL-12, IL-6R, IL-1R1, IL-1R2, IL-1RAcP, and IL-1Ra. The CXCL10, PD-1, IL-12, IL-6R, IL-1R1, IL-1R2, IL-1RAcP, and IL-1Ra may have the same sequences as those of naturally occurring CXCL10, PD-1, IL-12, IL-6R, IL-1R1, IL-1R2, IL-1RAcP, and IL-1Ra, respectively, or may be a ligand variant that differs in sequence from naturally occurring CXCL10, PD-1, IL-12, IL-6R, IL-1R1, IL-1R2, IL-1RAcP, and IL-1Ra, but retains the physiological activity of the corresponding natural ligand. In order to obtain the ligand variant, an alteration may be artificially added to the ligand sequence for various purposes. Preferably, an alteration to resist protease cleavage (protease resistance alteration) is added thereto to obtain a ligand variant.

In some embodiments of the present invention, the biological activity of the ligand is inhibited by binding to the uncleaved ligand-binding molecule. Examples of the embodiments in which the biological activity of the ligand is inhibited include, but are not limited to, embodiments in which the binding of the ligand to the uncleaved ligand-binding molecule substantially or significantly interferes or competes with the binding of the ligand to its binding partner. In the case of using an antibody or a fragment thereof having ligand neutralizing activity as the ligand-binding molecule, the ligand-binding molecule bound with the ligand is capable of inhibiting the biological activity of the ligand by exerting its neutralizing activity.

In one embodiment of the present invention, preferably, the uncleaved ligand-binding molecule can sufficiently neutralize the biological activity of the ligand by binding to the ligand. That is, the biological activity of the ligand bound with the uncleaved ligand-binding molecule is preferably lower than that of the ligand unbound with the uncleaved ligand-binding molecule. The biological activity of the ligand bound with the uncleaved ligand-binding molecule can be, for example, 90% or less, preferably 80% or less, 70% or less, 60% or less, 50% or less, 40% or less, or 30% or less, particularly preferably 20% or less, 10% or less, 9% or less, 8% or less, 7% or less, 6% or less, 5% or less, 4% or less, 3% or less, 2% or less, or 1% or less, of the biological activity of the ligand unbound with the uncleaved ligand-binding molecule, though not limited thereto. The administration of the ligand-binding molecule can be expected to prevent the ligand from exerting its biological activity before arriving at a target tissue, by sufficiently neutralizing the biological activity of the ligand.

Alternatively, the present invention provides methods for neutralizing the biological activity of a ligand. The methods of the present invention comprise the steps of contacting a ligand-binding molecule of the present invention with a ligand whose biological activity should be neutralized, and collecting the product of binding of the two molecules. Cleavage of the ligand-binding molecule in the collected binding product can restore the neutralized biological activity of the ligand. Thus, the methods for neutralizing the biological activity of a ligand according to the present invention may further comprise the step of restoring the biological activity of the ligand by cleaving the ligand-binding molecule in the binding product which consists of the ligand and the ligand-binding molecule (in other words, cancelling the neutralizing activity of the ligand-binding molecule).

In one embodiment of the present invention, the binding activity of the cleaved ligand-binding molecule against the ligand is preferably lower than that of an in vivo natural ligand binding partner (e.g., natural receptor for the ligand) against the ligand. The binding activity of the cleaved ligand-binding molecule against the ligand exhibits, for example, 90% or less, preferably 80% or less, 70% or less, 60% or less, 50% or less, 40% or less, or 30% or less, particularly preferably 20% or less, 10% or less, 9% or less, 8% or less, 7% or less, 6% or less, 5% or less, 4% or less, 3% or less, 2% or less, or 1% or less, of the amount of the ligand bound with the in vivo natural binding partner (per unit binding partner), though not limited thereto. The desired index may be appropriately used as an index for binding activity. For example, a dissociation constant (KD) may be used. In the case of using a dissociation constant (KD) as an index for evaluating binding activity, a larger dissociation constant (KD) of the cleaved ligand-binding molecule for the ligand than that of the in vivo natural binding partner for the ligand means that the cleaved ligand-binding molecule has weaker binding activity against the ligand than that of the in vivo natural binding partner. The dissociation constant (KD) of the cleaved ligand-binding molecule for the ligand is, for example, 1.1 times or more, preferably 1.5 times or more, 2 times or more, 5 times or more, or 10 times or more, particularly preferably 100 times or more of the dissociation constant (KD) of the in vivo natural binding partner for the ligand. The ligand-binding molecule having only low binding activity against the ligand or hardly having binding activity against the ligand after cleavage guarantees that the ligand is released by the cleavage of the ligand-binding molecule, and can be expected to be prevented from binding to another ligand molecule again.

The ligand desirably restores the suppressed biological activity after cleavage of the ligand-binding molecule. Attenuation of the binding of the cleaved ligand-binding molecule to the ligand desirably results in attenuation of the function of the ligand-binding molecule to inhibit the biological activity of the ligand. Those skilled in the art can confirm the biological activity of the ligand by a known method, for example, a method of detecting the binding of the ligand to its binding partner.

In some embodiments of the present invention, the uncleaved ligand-binding molecule forms a complex with the ligand through antigen-antibody binding. In a more specific embodiment, the complex of the ligand-binding molecule and the ligand is formed through a noncovalent bond, for example, antigen-antibody binding, between the ligand-binding molecule and the ligand.

In some embodiments of the present invention, the uncleaved ligand-binding molecule is fused with the ligand to form a fusion protein. The ligand-binding molecule moiety and the ligand moiety in the fusion protein further interact with each other through antigen-antibody binding. The ligand-binding molecule and the ligand can be fused via a linker or without a linker. Even when the ligand-binding molecule and the ligand in the fusion protein are fused via or without a linker, the noncovalent bond still exists between the ligand-binding molecule moiety and the ligand moiety. In other words, even in the embodiments in which the ligand-binding molecule is fused with the ligand, the noncovalent bond between the ligand-binding molecule moiety and the ligand moiety is similar to that in embodiments in which the ligand-binding molecule is not fused with the ligand. The noncovalent bond is attenuated by the cleavage of the ligand-binding molecule. In short, the ligand binding of the ligand-binding molecule is attenuated.

In a preferred embodiment of the present invention, the ligand-binding molecule and the ligand are fused via a linker. For example, an arbitrary peptide linker that can be introduced by genetic engineering, or a linker disclosed as a synthetic compound linker (see e.g., Protein Engineering, 9 (3), 299-305, 1996) can be used as the linker in the fusion of the ligand-binding molecule with the ligand. In the present embodiment, a peptide linker is preferred. The length of the peptide linker is not particularly limited and may be appropriately selected by those skilled in the art according to the purpose. Examples of the peptide linker can include, but are not limited to:

Ser
Gly·Ser (GS)
Ser·Gly (SG)
Gly·Gly·Ser (GGS)
Gly·Ser·Gly (GSG)
Ser·Gly·Gly (SGG)
Gly·Ser·Ser (GSS)
Ser·Ser·Gly (SSG)
Ser·Gly·Ser (SGS)
Gly·Gly·Gly·Ser (GGGS, SEQ ID NO: 36)
Gly·Gly·Ser·Gly (GGSG, SEQ ID NO: 37)
Gly·Ser·Gly·Gly (GSGG, SEQ ID NO: 38)
Ser·Gly·Gly·Gly (SGGG, SEQ ID NO: 39)
Gly·Ser·Ser·Gly (GSSG, SEQ ID NO: 40)
Gly·Gly·Gly·Gly·Ser (GGGGS, SEQ ID NO: 41)
Gly·Gly·Gly·Ser·Gly (GGGSG, SEQ ID NO: 42)
Gly·Gly·Ser·Gly·Gly (GGSGG, SEQ ID NO: 43)
Gly·Ser·Gly·Gly·Gly (GSGGG, SEQ ID NO: 44)
Gly·Ser·Gly·Gly·Ser (GSGGS, SEQ ID NO: 45)
Ser·Gly·Gly·Gly·Gly (SGGGG, SEQ ID NO: 46)
Gly·Ser·Ser·Gly·Gly (GSSGG, SEQ ID NO: 47)
Gly·Ser·Gly·Ser·Gly (GSGSG, SEQ ID NO: 48)
Ser·Gly·Gly·Ser·Gly (SGGSG, SEQ ID NO: 49)
Gly·Ser·Ser·Ser·Gly (GSSSG, SEQ ID NO: 50)
Gly·Gly·Gly·Gly·Gly·Ser (GGGGGS, SEQ ID NO: 51)
Ser·Gly·Gly·Gly·Gly·Gly (SGGGGG, SEQ ID NO: 52)
Gly·Gly·Gly·Gly·Gly·Gly·Ser (GGGGGGS, SEQ ID NO: 53)
Ser·Gly·Gly·Gly·Gly·Gly·Gly (SGGGGGG, SEQ ID NO: 54)
(Gly·Gly·Gly·Gly·Ser (GGGGS, SEQ ID NO: 41))n
(Ser·Gly·Gly·Gly·Gly (SGGGG, SEQ ID NO: 46))n
wherein n is an integer of 1 or larger.

However, the length and sequence of the peptide linker can be appropriately selected by those skilled in the art according to the purpose.

The synthetic compound linker (chemical cross-linking agent) is a cross-linking agent usually used in peptide cross-linking, for example, N-hydroxysuccinimide (NHS), disuccinimidyl suberate (DSS), bis(sulfosuccinimidyl) suberate (BS3), dithiobis(succinimidyl propionate) (DSP), dithiobis(sulfosuccinimidyl propionate) (DTSSP), ethylene glycol bis(succinimidyl succinate) (EGS), ethylene glycol bis(sulfosuccinimidyl succinate) (sulfo-EGS), disuccinimidyl tartrate (DST), disulfosuccinimidyl tartrate (sulfo-DST), bis [2-(succinimidoxycarbonyloxy)ethyl]sulfone (BSOCOES), or bis[2-(sulfosuccinimidoxycarbonyloxy)ethyl]sulfone (sulfo-BSOCOES). These cross-linking agents are commercially available.

The present invention also relates to a pharmaceutical composition (drug) comprising the ligand-binding molecule of the present invention and a pharmaceutically acceptable carrier, a pharmaceutical composition (drug) comprising the ligand-binding molecule of the present invention, a ligand, and a pharmaceutically acceptable carrier, and a pharmaceutical composition (drug) comprising a fusion protein of the ligand-binding molecule of the present invention fused with a ligand, and a pharmaceutically acceptable carrier.

The "treatment" (and its grammatically derived words, for example, "treat" and "treating") used in the present specification means clinical intervention that intends to alter the natural course of an individual to be treated, and it can be carried out both for prevention and during the course of a clinical pathological condition. The desirable effects of the treatment include, but not limited to, the prevention of the development or recurrence of a disease, the alleviation of symptoms, the attenuation of any direct or indirect pathological influence of the disease, the prevention of metastasis, reduction in the rate of progression of the disease, recovery from or alleviation of a disease condition, and ameliorated or improved prognosis. In some embodiments, the ligand-binding molecule of the present invention can control the biological activity of the ligand and is used for delaying the onset of a disease or delaying the progression of the disease.

In the present invention, the pharmaceutical composition usually refers to a drug for the treatment or prevention of a disease or for examination or diagnosis. In the present invention, the term "pharmaceutical composition comprising the ligand-binding molecule" may be used interchangeably with a "method for treating a disease, comprising administering the ligand-binding molecule to a subject to be treated" and may be used interchangeably with "use of the ligand-binding molecule for the production of a medicament for the treatment of a disease". Also, the term "pharmaceutical composition comprising the ligand-binding molecule" may be used interchangeably with "use of the ligand-binding molecule for treating a disease".

The term "pharmaceutical composition comprising the ligand-binding molecule and a ligand" may be used interchangeably with a "method for treating a disease, comprising administering the ligand-binding molecule and a ligand to a subject to be treated" and may be used interchangeably with "use of the ligand-binding molecule and a ligand for the production of a medicament for the treatment of a disease". Also, the term "pharmaceutical composition comprising the ligand-binding molecule and a ligand" may be used interchangeably with "use of the ligand-binding molecule and a ligand for treating a disease". The term "pharmaceutical composition comprising a fusion protein" may be used interchangeably with a "method for treating a disease, comprising administering a fusion protein to a subject to be treated" and may be used interchangeably with "use of a fusion protein for the production of a medicament for the treatment of a disease". Also, the term "pharmaceutical composition comprising a fusion protein" may be used interchangeably with "use of a fusion protein for treating a disease".

In some embodiments of the present invention, a composition containing the ligand-binding molecule can be administered to an individual. The ligand-binding molecule administered to an individual binds to a ligand originally present in the individual, for example, in blood or in a tissue, and the ligand-binding molecule in a state bound with the ligand is further transported in vivo. The ligand-binding molecule transported to a target tissue can be cleaved in the target tissue so that its binding to the ligand can be attenuated to release the bound ligand in the target tissue. The released ligand can exert biological activity in the target tissue and treat a disease originated in the target tissue. In the embodiments in which the ligand-binding molecule suppresses the biological activity of the ligand when bound with the ligand, and is cleaved specifically in a target tissue, the ligand does not exert biological activity during transport and exerts biological activity only when the ligand-binding molecule is cleaved in the target tissue. As a result, the disease can be treated with reduced systemic adverse reactions.

In some embodiments of the present invention, a composition containing the ligand-binding molecule and a composition containing the ligand can be administered separately or concurrently to an individual. Alternatively, a composition containing both the ligand-binding molecule and the ligand may be administered to an individual. In the case of administering a composition containing both the ligand-binding molecule and the ligand to an individual, the ligand-binding molecule and the ligand in the composition may form a complex. In the case of administering both the ligand-binding molecule and the ligand to an individual, the ligand-binding molecule binds to the ligand administered to the individual, and the ligand-binding molecule in a state bound with the ligand is transported in vivo. The ligand-binding molecule transported to a target tissue can be cleaved in the target tissue so that its binding to the ligand is attenuated to release the bound ligand in the target tissue. The released ligand can exert biological activity in the target tissue and treat a disease originated in the target tissue. In the embodiments in which the ligand-binding molecule suppresses the biological activity of the ligand when bound with the ligand, and is cleaved specifically in a target tissue, the ligand does not exert biological activity during transport and exerts biological activity only when the ligand-binding molecule is cleaved in the target tissue. As a result, the disease can be treated with systemic adverse reactions reduced. The ligand-binding molecule administered to the individual is also capable of binding to a ligand originally present in the individual, in addition to the ligand administered to the individual. The ligand-binding molecule in a state bound with the ligand originally present in the individual or the ligand administered to the individual can be transported in vivo. Thus, the present invention also provides methods for producing a complex consisting of a ligand-binding molecule and a ligand, wherein the methods comprise contacting the ligand-binding molecule with the ligand and collecting the complex. The complexes of the present invention can be formulated, for example, with a pharmaceutically acceptable carrier to make a pharmaceutical composition.

In some embodiments of the present invention, the fusion protein of the ligand-binding molecule fused with a ligand can be administered to an individual. In these embodiments, the ligand-binding molecule and the ligand in the fusion protein are fused via or without a linker. The noncovalent bond still exists between the ligand-binding molecule moiety and the ligand moiety. In the case of administering the fusion protein of the ligand-binding molecule fused with a ligand to an individual, the fusion protein is transported in vivo, and then the ligand-binding molecule moiety in the fusion protein is cleaved in a target tissue so that the noncovalent bond of the ligand-binding molecule moiety to the ligand is attenuated to release the ligand and a portion of the ligand-binding molecule from the fusion protein. The released ligand and the released portion of the ligand-binding molecule can exert the biological activity of the ligand in the target tissue, and treat a disease originated in the target tissue. In the embodiments in which the ligand-binding molecule suppresses the biological activity of the ligand when bound with the ligand, and is cleaved specifically in a target tissue, the ligand in the fusion protein does not exert biological activity during transport and exerts biological activity only when the fusion protein is cleaved in the target tissue. As a result, the disease can be treated with reduced systemic adverse reactions. Thus, the present invention provides methods of administering a ligand to a subject in need thereof, wherein the methods comprise:

(1) contacting a ligand with a ligand-binding molecule of the present invention to obtain a product of binding of the two molecules; and (2) administering the binding product of (1) to a subject in need of administration of the ligand.

The pharmaceutical composition of the present invention can be formulated by use of a method known to those skilled in the art. For example, the pharmaceutical composition can be parenterally used in a form of an injection of a sterile solution or suspension with water or any other pharmaceutically acceptable liquids. The pharmaceutical composition can be formulated, for example, by appropriately combining with a pharmacologically acceptable carrier or medium, specifically, sterile water or physiological saline, a vegetable oil, an emulsifier, a suspending agent, a surfactant, a stabilizer, a flavoring agent, an excipient, a vehicle, an antiseptic, a binder, etc. and mixing them into a unit dosage form required for generally accepted pharmaceutical practice. The amount of the active ingredient in these formulations is set so as to give an appropriate volume in a prescribed range.

A sterile composition for injection can be formulated according to usual pharmaceutical practice using a vehicle such as injectable distilled water. Examples of the injectable aqueous solution include isotonic solutions containing physiological saline, glucose, or other adjuvants (e.g., D-sorbitol, D-mannose, D-mannitol, and sodium chloride). The aqueous solution can be used in combination with an appropriate solubilizer, for example, an alcohol (ethanol, etc.), a polyalcohol (propylene glycol, polyethylene glycol, etc.), or a nonionic surfactant (Polysorbate 80™, HCO-50, etc.).

Examples of the oily liquid include sesame oil and soybean oil, and benzyl benzoate and/or benzyl alcohol can be used in combination as a solubilizer. The oily liquid can be combined with a buffer (e.g., a phosphate buffer solution and a sodium acetate buffer solution), a soothing agent (e.g., procaine hydrochloride), a stabilizer (e.g., benzyl alcohol and phenol), or an antioxidant. The prepared injection solution is usually filled into an appropriate ampule.

The pharmaceutical composition of the present invention is preferably administered through a parenteral route. For example, a composition for injection, transnasal administration, transpulmonary administration, or percutaneous administration is administered. The pharmaceutical composition can be administered systemically or locally by, for example, intravenous injection, intramuscular injection, intraperitoneal injection, or subcutaneous injection.

The administration method can be appropriately selected according to the age and symptoms of a patient. The dose of the pharmaceutical composition containing the ligand-binding molecule can be determined to the range of, for example, 0.0001 mg to 1000 mg per kg body weight per dose. Alternatively, the dose can be determined to, for example, 0.001 to 100000 mg per patient. However, the present invention is not necessarily limited by these numerical values. The dose and the administration method vary depending on the body weight, age, symptoms, and such of a patient, and those skilled in the art can determine an appropriate dose and administration method in consideration of these conditions.

The present invention also relates to a method for producing a ligand-binding molecule whose binding to a ligand is attenuated when it is cleaved, or a fusion protein of the ligand-binding molecule fused with a ligand. In one embodiment, the present invention provides a method for producing the ligand-binding molecule or the fusion protein, comprising introducing a protease cleavage sequence into a molecule capable of binding to a ligand.

Examples of the method for introducing a protease cleavage sequence into a molecule capable of binding to a ligand include a method of inserting the protease cleavage sequence into the amino acid sequence of a polypeptide capable of binding to the ligand, and a method of replacing a portion of the amino acid sequence of a polypeptide capable of binding to the ligand with the protease cleavage sequence.

To "insert" amino acid sequence A into amino acid sequence B refers to splitting amino acid sequence B into two parts without deletion, and linking the two parts with amino acid sequence A (that is, producing such an amino acid sequence as "first half of amino acid sequence B-amino acid sequence A-second half of amino acid sequence B"). To "introduce" amino acid sequence A into amino acid sequence B refers to splitting amino acid sequence B into two parts and linking the two parts with amino acid sequence A. This encompasses not only "inserting" amino acid sequence A into amino acid sequence B as mentioned above, but also linking the two parts with amino acid sequence A after deleting one or more amino acid residues of amino acid sequence B including those adjacent to amino acid sequence A (that is, replacing a portion of amino acid sequence B with amino acid sequence A).

Examples of the method for obtaining the molecule capable of binding to a ligand include a method of obtaining a ligand binding region having the ability to bind to the ligand. The ligand binding region is obtained by a method using, for example, an antibody preparation method known in the art.

The antibody obtained by the preparation method may be used directly for the ligand binding region, or only a Fv region in the obtained antibody may be used. When the Fv region in a single-chain (also referred to as "sc") form is capable of recognizing the antigen, only the single chain may be used. Alternatively, a Fab region containing the Fv region may be used.

The specific antibody preparation methods are well known to those skilled in the art. For example, monoclonal antibodies may be produced by a hybridoma method (Kohler and Milstein, Nature 256:495 (1975)) or a recombination method (U.S. Pat. No. 4,816,567). Alternatively, monoclonal antibodies may be isolated from phage-displayed antibody libraries (Clackson et al., Nature 352:624-628 (1991); and Marks et al., J. Mol. Biol. 222:581-597 (1991)). Also, monoclonal antibodies may be isolated from single B cell clones (N. Biotechnol. 28 (5): 253-457 (2011)).

Humanized antibodies are also called reshaped human antibodies. Specifically, for example, a humanized antibody produced by grafting the CDRs of a non-human animal (e.g., mouse) antibody to human antibody is known in the art. General gene recombination approaches for obtaining humanized antibodies are also known. Specifically, for example, overlap extension PCR is known in the art as a method for grafting the CDRs of mouse antibody to human FRs.

DNA encoding an antibody variable region in which three CDRs are linked with four FRs and DNA encoding a human antibody constant region can be inserted into an expression vector such that these DNAs are fused in frame to prepare a vector for the expression of a humanized antibody. The vector having the inserts is transfected into a host to establish recombinant cells. Then, the recombinant cells are cultured for the expression of DNA encoding the humanized antibody to produce the humanized antibody into the cultures of the cultured cells (see European Patent Publication No. 239400 and International Publication No. WO1996/002576).

If necessary, amino acid residues of FRs may be substituted such that the CDRs of the reshaped human antibody form an appropriate antigen binding site. For example, a mutation can be introduced to the amino acid sequence of FRs by applying the PCR method used for grafting the mouse CDRs to the human FRs.

The desired human antibody can be obtained by DNA immunization using transgenic animals having all repertoires of human antibody genes (see International Publication Nos. WO1993/012227, WO1992/003918, WO1994/002602, WO1994/025585, WO1996/034096, and WO1996/033735) as animals to be immunized.

In addition, a technique of obtaining human antibodies by panning using a human antibody library is also known. For example, a human antibody Fv region is expressed as a single-chain antibody (also referred to as "scFv") on the surface of phages by a phage display method. A phage which expresses antigen-binding scFv can be selected. The gene of the selected phage can be analyzed to determine a DNA sequence encoding the Fv region of the antigen binding human antibody. After the determination of the DNA sequence of the antigen binding scFv, the Fv region sequence can be fused in frame with the sequence of the desired human antibody C region and then inserted into an appropriate expression vector to prepare an expression vector. The expression vector is transfected into the preferred expression cells as listed above for the expression of the gene encoding the human antibody to obtain the human antibody. These methods are already known in the art (see International Publication Nos. WO1992/001047, WO1992/020791, WO1993/006213, WO1993/011236, WO1993/019172, WO1995/001438, and WO1995/015388).

The molecule with a protease cleavage sequence introduced in the molecule capable of binding to a ligand serves as the ligand-binding molecule of the present invention. Whether the ligand-binding molecule is cleaved by treatment with protease appropriate for the protease cleavage sequence can be optionally confirmed. The presence or absence of the cleavage of the protease cleavage sequence can be confirmed, for example, by contacting the protease with the molecule with a protease cleavage sequence introduced in the molecule capable of binding to a ligand, and determining the molecular weight of the protease-treated product by an electrophoresis method such as SDS-PAGE.

Furthermore, cleavage fragments after protease treatment can be separated by electrophoresis such as SDS-PAGE and quantified to evaluate the activity of the protease and the cleavage ratio of a molecule into which the protease cleavage sequence has been introduced. A non-limiting embodiment of the method of evaluating the cleavage ratio of a molecule into which a protease cleavage sequence has been introduced includes the following method: For example, when the cleavage ratio of an antibody variant into which a protease cleavage sequence has been introduced is evaluated using recombinant human u-Plasminogen Activator/Urokinase (human uPA, huPA) (R&D Systems; 1310-SE-010) or recombinant human Matriptase/ST14 Catalytic Domain (human MT-SP1, hMT-SP1) (R&D Systems; 3946-SE-010), 100 μg/mL of the antibody variant is reacted with 40 nM huPA or 3 nM hMT-SP1 in PBS at 37° C. for one hour, and then subjected to capillary electrophoresis immunoassay. Capillary electrophoresis immunoassay can be performed using Wes (Protein Simple), but the present method is not limited thereto. As an alternative to capillary electrophoresis immunoassay, SDS-PAGE and such may be performed for separation, followed by detection with Western blotting. The present method is not limited to these methods. Before and after cleavage, the light chain can be detected using anti-human lambda chain HRP-labeled antibody (abcam; ab9007), but any antibody that can detect cleavage fragments may be used. The area of each peak obtained after protease treatment is output using software for Wes (Compass for SW; Protein Simple), and the cleavage ratio (%) of the antibody variant can be determined with the following formula:

(Peak area of cleaved light chain)×100/(Peak area of cleaved light chain+Peak area of uncleaved light chain)

Cleavage ratios can be determined if protein fragments can be detected before and after protease treatment. Thus, cleavage ratios can be determined not only for antibody variants but also for various protein molecules into which a protease cleavage sequence has been introduced.

The in vivo cleavage ratio of a molecule into which a protease cleavage sequence has been introduced can be determined by administering the molecule into animals and detecting the administered molecule in blood samples. For example, an antibody variant into which a protease cleavage sequence has been introduced is administered to mice, and plasma is collected from their blood samples. The antibody is purified from the plasma by a method known to those skilled in the art using Dynabeads Protein A (Thermo; 10001D), and then subjected to capillary electrophoresis immunoassay to evaluate the protease cleavage ratio of the antibody variant. Capillary electrophoresis immunoassay can be performed using Wes (Protein Simple), but the present method is not limited thereto. As an alternative to capillary electrophoresis immunoassay, SDS-PAGE and such may be performed for separation, followed by detection with Western blotting. The present method is not limited to these methods. The light chain of the antibody variant collected from mice can be detected using anti-human lambda chain HRP-labeled antibody (abcam; ab9007), but any antibody that can detect cleavage fragments may be used. Once the area of each peak obtained by capillary electrophoresis immunoassay is output using software for Wes (Compass for SW; Protein Simple), the ratio of the remaining light chain can be calculated as [Peak area of light chain]/[Peak area of heavy chain] to determine the ratio of the full-length light chain that remain uncleaved in the mouse body. In vivo cleavage efficiencies can be determined if protein fragments collected from a living organism are detectable. Thus, cleavage ratios can be determined not only for antibody variants but also for various protein molecules into which a protease cleavage sequence has been introduced. Calculation of cleavage ratios by the above-mentioned methods enables, for example, comparison of the in vivo cleavage ratios of antibody variants into which different cleavage sequences have been introduced, and comparison of the cleavage ratio of a single antibody variant between different animal models such as a normal mouse model and a tumor-grafted mouse model.

The present invention also relates to a polynucleotide encoding a ligand-binding molecule whose binding to the ligand is attenuated by cleavage, or a polynucleotide encoding a fusion protein in which the ligand-binding molecule is fused with a ligand.

The polynucleotide according to the present invention is usually carried by (or inserted in) an appropriate vector and transfected into host cells. The vector is not particularly limited as long as the vector can stably retain an inserted nucleic acid. For example, when *E. coli* is used as the host, a pBluescript vector (manufactured by Stratagene Corp.) or the like is preferred as a vector for cloning, although various commercially available vectors can be used. In the case of using a vector for the purpose of producing the ligand-binding molecule or the fusion protein of the present invention, an expression vector is particularly useful. The expression vector is not particularly limited as long as the vector permits expression of the ligand-binding molecule in vitro, in E. coli, in cultured cells, or in individual organisms. The expression vector is preferably, for example, a pBEST vector (manufactured by Promega Corp.) for in vitro expression, a pET vector (manufactured by Invitrogen Corp.) for expression in E. coli, a pME18S-FL3 vector (GenBank Accession No. AB009864) for expression in cultured cells, and a pME18S vector (Mol Cell Biol. 8:466-472 (1988)) for expression in individual organisms. The insertion of the DNA of the present invention into the vector can be performed by a routine method, for example, ligase reaction using restriction sites (Current protocols in Molecular Biology edit. Ausubel et al. (1987) Publish. John Wiley & Sons. Section 11.4-11.11).

The host cells are not particularly limited, and various host cells are used according to the purpose. Examples of the cells for expressing the ligand-binding molecule or the fusion protein may include bacterial cells (e.g., Streptococcus, Staphylococcus, E. coli, Streptomyces, and Bacillus subtilis), fungal cells (e.g., yeasts and Aspergillus), insect cells (e.g., Drosophila S2 and Spodoptera SF9), animal cells (e.g., CHO, COS, HeLa, C127, 3T3, BHK, HEK293, and Bowes melanoma cells) and plant cells. The transfection of the vector to the host cells may be performed by a method known in the art, for example, a calcium phosphate precipitation method, an electroporation method (Current protocols in Molecular Biology edit. Ausubel et al., (1987) Publish. John Wiley & Sons. Section 9.1-9.9), a Lipofectamine method (manufactured by GIBCO-BRL/Thermo Fisher Scientific Inc.), or a microinjection method.

An appropriate secretory signal can be incorporated into the ligand-binding molecule or the fusion protein of interest, in order to secrete the ligand-binding molecule or the fusion protein expressed in the host cells to the endoplasmic reticulum lumen, periplasmic space, or an extracellular environment. The signal may be endogenous to the ligand-binding molecule or the fusion protein of interest, or may be a foreign signal.

When the ligand-binding molecule or the fusion protein of the present invention is secreted into a medium, the recovery of the ligand-binding molecule or the fusion protein in the above production method. When the ligand-binding molecule or the fusion protein of the present invention is produced into cells, the cells are first lysed, followed by the recovery of the ligand-binding molecule or the fusion protein.

A method known in the art including ammonium sulfate or ethanol precipitation, acid extraction, anion- or cation-exchange chromatography, phosphocellulose chromatography, hydrophobic interaction chromatography, affinity chromatography, hydroxylapatite chromatography, and lectin chromatography can be used for recovering and purifying the ligand-binding molecule or the fusion protein of the present invention from the recombinant cell cultures.

It should be naturally understood by those skilled in the art that any combinations of one or more embodiments described in the present specification are also included in the present invention unless there is technical contradiction on the basis of the common knowledge in the art. Also, the present invention excluding an arbitrary combination of one or more embodiments described in the present specification and should be interpreted as being contemplated by and described in the specification, unless there is technical contradiction on the basis of the common knowledge in the art.

EXAMPLES

Hereinafter, Examples of the method and the composition of the present invention will be described. It shall be understood that various other embodiments can be carried out in light of the general description mentioned above.

Example 1 Problem of Previously Reported Immunocytokine and Protease-Activated Cytokine Immunocytokines targeting antigens expressed in cancer tissues have generally been prepared by fusing the cytokine of interest to the terminus of targeting IgG or scFv (Expert Opin Investig Drugs. 2009 July; 18 (7): 991-1000; and Curr Opin Immunol. 2016 June; 40:96-102). Since cytokines including IL-2, IL-12, and TNF are very toxic, delivering these cytokines locally to cancer using an antibody to allow them to act locally on the cancer is expected to provide enhanced effects with alleviated adverse reactions (Non Patent Literatures 4, 5, and 6). However, all of these molecules present problems such as poor clinical effect in systemic administration; narrow therapeutic windows; and being too toxic to be administered systemically. This is largely because cytokines, including immunocytokines, are exposed to the whole body after systemic administration, and therefore may act and exhibit toxicity in a systemic manner, or can only be administered at very low doses in order to circumvent the toxicity. Moreover, immunocytokines binding to cancer antigens disappear in tumors through internalization by cancer cells, and therefore it is sometimes difficult to locally expose tumor to cytokines. It has also been reported that there was no difference in antitumor effect between an immunocytokine composed of IL-2 fused with an antibody that binds to a cancer antigen and an immunocytokine composed of IL-2 fused with an antibody that does not bind to the cancer antigen (Non Patent Literature 7).

As a means to reduce the systemic action of immunocytokines, which is a major problem of immunocytokines, a molecule composed of a cytokine connected with a cytokine receptor via a linker that is cleaved by protease highly expressed in cancer has been reported. The cytokine is inhibited by the cytokine receptor connected therewith via the linker, but upon protease cleavage of the linker, the cytokine is released and thereby becomes an active form. For example, a molecule in which TNF-alpha and TNFR are connected via a linker that is cleaved by uPA (Non Patent Literature 8), and a molecule in which IL-2 and IL-2R are connected via a linker that is cleaved by MMP-2 (Non Patent Literature 9) have been reported. However, the cytokines in these molecules have biological activity even before cleavage of the linker, and the cleavage of the linker improves the activity by only approximately 10 times.

The following two points may be raised as their cause: the cytokines do not have strong affinity for their receptors and therefore are active to some extent even before protease cleavage; or the cytokine receptors can bind to the cytokines even after protease cleavage of the linker and therefore inhibit the biological activity of the cytokines.

A molecule in which IL-2 is connected with anti-IL2 scFv instead of IL-2R via a linker that is cleaved by MMP-2 (Non Patent Literature 9) has been reported. The anti-IL-2 scFv used in this molecule, in which IL-2 is connected with the anti-IL-2 scFv via a protease-cleavable linker, does not have strong IL-2 affinity, as a matter of course, considering that IL-2 is released by the cleavage of the linker, as in the molecule in which a cytokine is connected with a cytokine receptor.

Unlike the IgG-IL-2 fusion mentioned above, these reported protease-activated cytokines have no Fc region and therefore presumably have a short half-life. Thus, it is difficult to maintain high exposure. The cytokines do not largely differ in pharmacokinetics before and after the activation by protease cleavage (have a short half-life both before and after the activation). Thus, it is difficult to expand their therapeutic windows.

Example 2 Problem Associated with Application of Chemokine to Cancer Immunotherapy Chemokines (Nature Immunology 9, 949-952 (2008)) are basic proteins that exert their effects via G protein-coupled receptors and are a group of cytokines. The chemokines act on particular leukocytes that express its receptor, and have the activity of causing migration (chemotaxis) of the leukocytes in the direction of the concentration gradients thereof (Nat Cell Biol. 2016 January; 18 (1): 43-53). The chemokines are produced in large amounts at inflamed areas and are known to bring about leukocyte migration from blood vessels into inflammatory tissues.

The chemokines are considered to be exploitable in cancer immunotherapy because leukocyte migration can be controlled by controlling the chemokines. If the local migration of T cells, antigen-presenting cells, M1 macrophages, etc. to solid cancer is attained, it may be possible to elicit an antitumor effect. Cytokines can function even by systemic administration, whereas the chemokines guide the cells towards tissues of increasing concentration through their concentration gradients and therefore cannot achieve an expected effect by systemic administration. Hence, cancer immunotherapy with the chemokines by systemic administration (chemokine therapy) is considered unpractical.

Example 3 Concept of Ligand-Binding Molecule with Introduced Protease Cleavage Sequence, which is Capable of Releasing Target Tissue-Specific Ligand As shown in Examples 1 and 2, previously reported cytokine or chemokine therapies present the following problems:
1. Immunocytokines cause adverse reactions even if the cytokine is targeted to a solid cancer by the antibody, because cytokines act systemically to produce adverse reactions, or can be administered only at low doses in order to circumvent such adverse reactions, and therefore, tumors cannot be highly exposed to immunocytokines.
2. Protease-activated cytokines, in which a cytokine receptor (or an antibody) and a cytokine are connected via a protease-cleavable linker, are active to some extent even before protease cleavage due to the insufficient neutralization of the cytokine activity.
3. The cytokine receptors (or the antibodies) can bind to the protease-activated cytokines even after protease cleavage of the linker and therefore inhibits the biological activity of the cytokine.
4. The protease-activated cytokines require higher dose because an inactive cytokine has a short half-life and has a short circulation time in blood.

It is considered important to satisfy the following conditions in order to solve these problems:
1. A ligand such as a cytokine or a chemokine is sufficiently inhibited (the biological activity thereof is minimized) by a ligand-binding molecule in the whole body.
2. The ligand restores its biological activity (becomes an active ligand) by protease cleavage.
3. The ligand-binding molecule loses its ligand binding activity by protease cleavage.
4. The ligand activated by protease cleavage has a shorter half-life than the ligand bound with the ligand-binding molecule before the protease cleavage.

The present inventors devised a molecule whose binding to a ligand is attenuated by the cleavage of a cleavage site, as a pharmaceutical composition that satisfies the conditions described above. Such a ligand-binding molecule can be prepared by first obtaining a binding molecule to the ligand and subsequently inserting a cleavage site into the binding molecule.

Example 4 Example of Anti-Ligand Antibody with Introduced Protease Cleavage Sequence FIGS. 1A, 1B, 2A, 2B, and 3 show examples of molecules using an antibody as the ligand-binding molecule. In these examples, a neutralizing antibody against the ligand is first obtained. Subsequently, a protease cleavage sequence is introduced near the boundary between the variable region (VH or VL) and the constant region (CH1 or CL) of the anti-ligand neutralizing antibody. It is confirmed that the anti-ligand antibody maintains its ligand binding activity after the introduction of the protease cleavage sequence. It is confirmed that the ligand bound with the anti-ligand neutralizing antibody is dissociated by the protease cleavage. It is confirmed that the ligand thus dissociated exerts biological activity.

In FIGS. 1A and 1B, the C terminus of the ligand and the N terminus of VH of the anti-ligand antibody are connected via a linker, and a protease cleavage sequence is introduced near the boundary between the VH and CH1. When the affinity of the anti-ligand antibody to the ligand is strong enough, the biological activity of the ligand is sufficiently inhibited. This ligand-anti-ligand antibody fusion does not exert the biological activity even by systemic administration, because the ligand is neutralized. Furthermore, the ligand-anti-ligand antibody fusion has a Fc region and therefore has a long half-life. A molecule of ligand-linker-anti-ligand antibody VH is released from the systemically administered ligand-anti-ligand antibody fusion, when the protease cleavage sequence near the boundary between VH and CH1 is cleaved by protease highly expressed in a tumor tissue. Since VH or VL alone cannot bind to the ligand (both VH and VL are necessary for binding to the ligand), the neutralization of the ligand is canceled so that the ligand is capable of exerting its biological effect in the tumor tissue. Also, this released molecule of ligand-linker-anti-ligand antibody VH lacks a Fc region and has small molecular weight, and therefore has a very short half-life and disappears rapidly from the whole body. Hence, the systemic adverse reactions caused by the ligand can be minimized.

In FIGS. 2A and 2B, the ligand and the anti-ligand antibody are not connected via a linker, unlike FIGS. 1A and 1B, and an anti-ligand antibody in which a protease cleavage sequence is introduced near the boundary between VH and CH1 is mixed with the ligand and administered. When the affinity of the anti-ligand antibody to the ligand is strong enough and the level of anti-ligand antibody is adequate for the ligand concentration, the biological activity of the ligand is sufficiently inhibited. This ligand-anti-ligand antibody complex does not exert the biological activity even by systemic administration, because the ligand is neutralized. Furthermore, the ligand-anti-ligand antibody complex has a Fc region and therefore has a long half-life. VH molecule of the anti-ligand antibody is released from the systemically administered ligand-anti-ligand antibody complex, when the protease cleavage sequence near the boundary between VH and CH1 is cleaved by protease highly expressed in a tumor tissue. Since VH or VL alone cannot bind to the ligand (both VH and VL are necessary for binding to the ligand), the neutralization of the ligand is canceled so that the ligand is capable of exerting its biological effect in the tumor tissue. Also, this released ligand molecule lacks a Fc region and has a small molecular weight, and therefore has a very short half-life and disappears rapidly from the whole body. Hence, the systemic adverse reactions caused by the ligand can be minimized.

Figure 3:
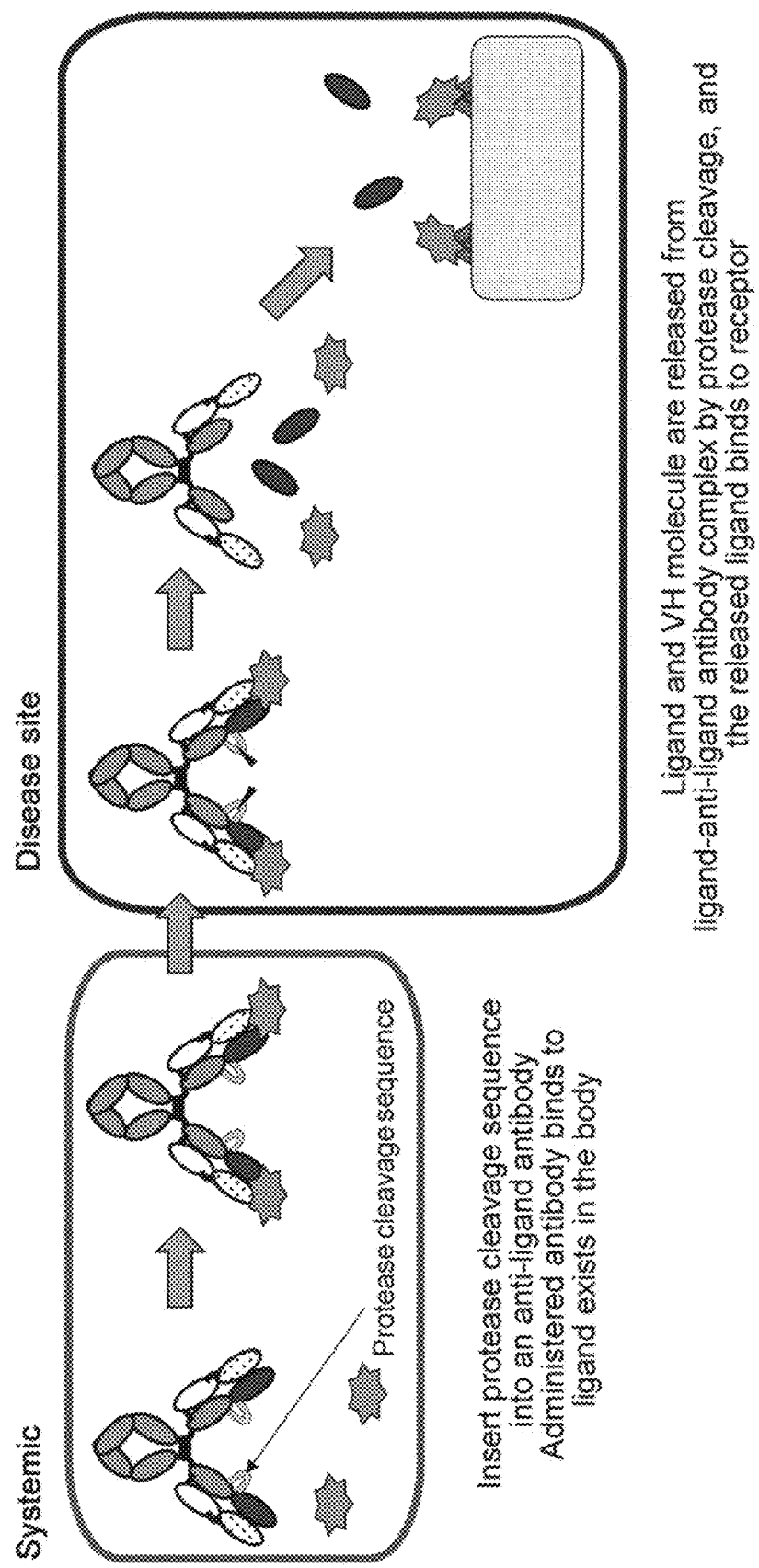
FIG. 3 is a diagram showing an IgG antibody that releases a ligand specifically in a target tissue, and one mode of activation thereof. An anti-ligand antibody with a protease cleavage sequence inserted near the boundary between VH and CH1 is administered to an individual. The administered antibody binds to a ligand originally present in the body. The subsequent course is the same as in the activation mode of FIGS. 2A and 2B.

In FIG. 3, an anti-ligand antibody in which a protease cleavage sequence is introduced near the boundary between VH and CH1 is systemically administered. The administered antibody binds to a ligand originally present in the body. The subsequent course is the same as in the above description about FIGS. 2A and 2B.

Thus, use of the anti-ligand antibody in which a protease cleavage sequence is introduced near the boundary between VH and CH1 can release the ligand selectively in a protease-expressing tissue and allow the ligand to exert its biological effect. When the ligand is a cytokine, the cytokine can be allowed to act selectively in a protease-expressing tissue. When the ligand is a chemokine, the chemokine can guide chemokine receptor-expressing cells to a protease-expressing tissue, because the chemokine is present at a high concentration in the protease-expressing tissue and has a low concentration in peripheral blood.

Example 5 Preparation and Evaluation of CXCL10 Releasing Antibody 5-1. Introduction of Protease Cleavage Sequence to Anti-CXCL10 Neutralizing Antibody CXCL10 is a chemokine having a chemotactic effect on effector T cells. An expression vector of MabCXCL10 (heavy chain: EEIVH (SEQ ID NO: 1), light chain: EEIVL (SEQ ID NO: 2)), a neutralizing antibody against human CXCL10, was prepared by a method known to those skilled in the art, and expressed using FreeStyle™ 293 (Life Technologies Corp.) and purified by methods known to those skilled in the art. MabCXCL10 contained the following CDR sequences: H-CDR1 (NNGMH; SEQ ID NO: 380), H-CDR2 (VIWFDGMNKFYVDSVKG; SEQ ID NO: 381), H-CDR3 (EGDGSGIYYYYGMDV; SEQ ID NO: 382), L-CDR1 (RASQSVSSSYLA; SEQ ID NO: 383), L-CDR2 (GASSRAT; SEQ ID NO: 384), and L-CDR3 (QQYGSSPIFT; SEQ ID NO: 385).

Figure 4:
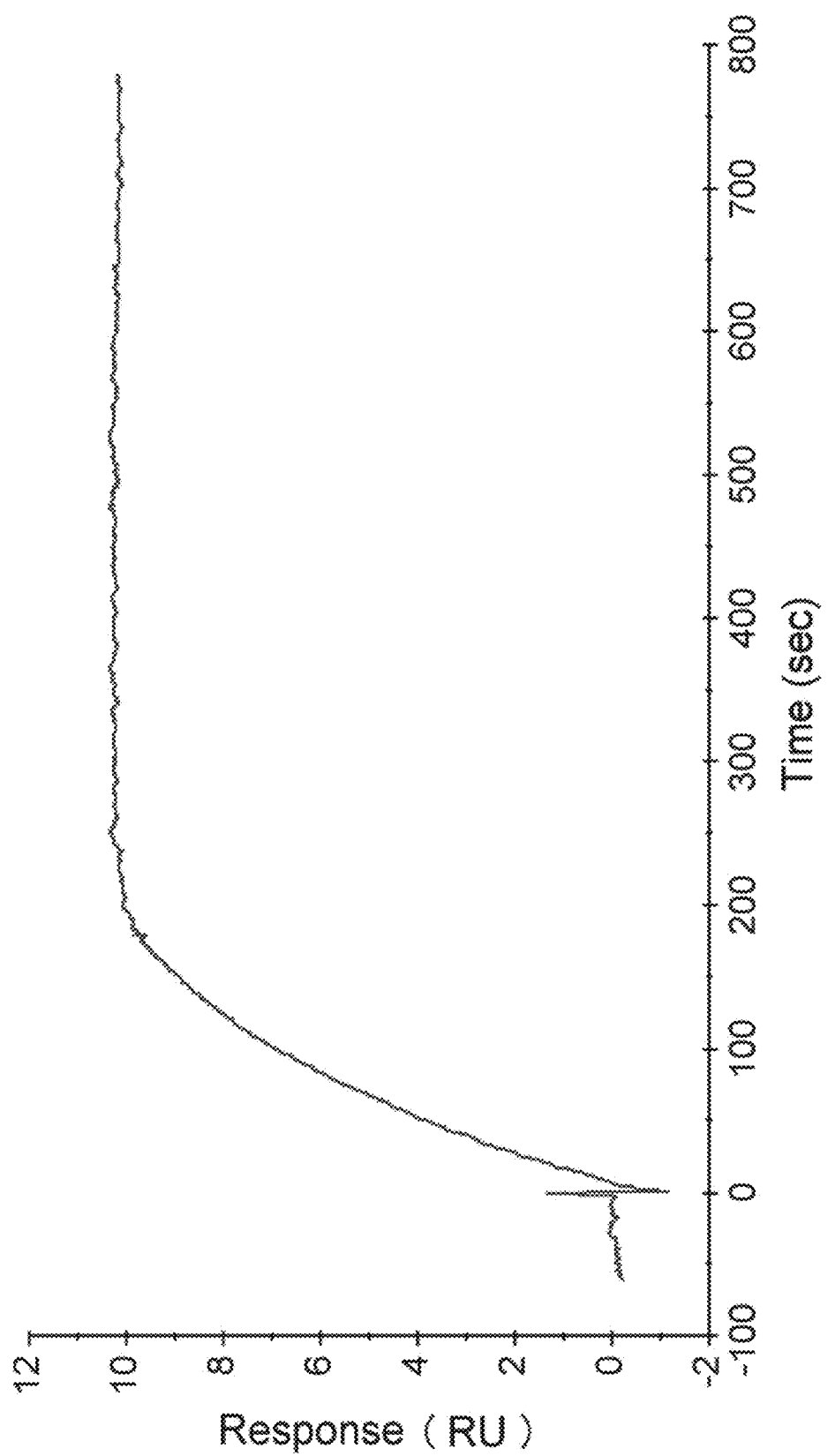
FIG. 4 is a diagram showing results of evaluating the interaction between MabCXCL10 and human CXCL10 using Biacore®.

The interaction between MabCXCL10 and human CXCL10 (266-IP-010/CF, R&D Systems, Inc.) was evaluated using Biacore®. Specifically, R PROTEIN A (SURE) (28-4018-60, GE Healthcare Japan Corp.) was immobilized onto CM3 sensor chip (BR100536, GE Healthcare Japan Corp.) by the amine coupling method using NHS.EDC. The running buffer used was 20 mM ACES, 0.05% Tween®20, and 200 mM NaCl (pH 7.4). 1.563 nM human CXCL10 was applied as an analyte with the antibody captured, and the binding of the antibody to the antigen was evaluated at 37° C. FIG. 4 depicts a sensorgram showing binding amount over time after a blank value using an analyte consisting only of the running buffer was subtracted. The time of starting application of the analyte was plotted as a starting point on the abscissa. When the response at the time of starting application of the analyte was defined as 0, a response (binding amount) at each time point was plotted on the ordinate. As shown in the sensorgram of FIG. 4, the binding of MabCXCL10 to the human CXCL10 was confirmed.

Study was conducted for the insertion of a protease cleavage sequence near the boundary between the heavy chain or light chain variable region and constant region of MabCXCL10. Heavy chains and light chains shown in FIG. 5 were designed such that peptide sequence A (SEQ ID NO: 3), which is reportedly cleavable by urokinase (uPA) and matriptase (MT-SP1), which are expressed specifically in cancer, was inserted at 7 sites near the boundary between the heavy chain or light chain variable region and constant region. Variants which is modified to avoid glycosylation upon the cleavage sequence insertion were also designed. Expression vectors encoding the heavy chain variants: EEIVHA (SEQ ID NO: 4), EEIVHB (SEQ ID NO: 5), EEIVHC (SEQ ID NO: 6), EEIVHD (SEQ ID NO: 7), EEIVHE (SEQ ID NO: 8), EEIVHF (SEQ ID NO: 9), EEIVHG (SEQ ID NO: 10), EEIVHBG (SEQ ID NO: 11), EEIVHCG (SEQ ID NO: 12), EEIVHDG (SEQ ID NO: 13), and EEIVHEG (SEQ ID NO: 14), and the light chain variants: EEIVLA (SEQ ID NO: 15), EEIVLB (SEQ ID NO: 16), EEIVLC (SEQ ID NO: 17), EEIVLD (SEQ ID NO: 18), EEIVLE (SEQ ID NO: 19), EEIVLF (SEQ ID NO: 20), EEIVLG (SEQ ID NO: 21), and EEIVLEG (SEQ ID NO: 22), were prepared by a method known to those skilled in the art. IgG1 antibodies: EEIVHA/EEIVL (heavy chain: SEQ ID NO: 4, light chain: SEQ ID NO: 2), EEIVHB/EEIVL (heavy chain: SEQ ID NO: 5, light chain: SEQ ID NO: 2), EEIVHC/EEIVL (heavy chain: SEQ ID NO: 6, light chain: SEQ ID NO: 2), EEIVHD/EEIVL (heavy chain: SEQ ID NO: 7, light chain: SEQ ID NO: 2), EEIVHE/EEIVL (heavy chain: SEQ ID NO: 8, light chain: SEQ ID NO: 2), EEIVHF/EEIVL (heavy chain: SEQ ID NO: 9, light chain: SEQ ID NO: 2), EEIVHG/EEIVL (heavy chain: SEQ ID NO: 10, light chain: SEQ ID NO: 2), EEIVHBG/EEIVL (heavy chain: SEQ ID NO: 11, light chain: SEQ ID NO: 2), EEIVHCG/EEIVL (heavy chain: SEQ ID NO: 12, light chain: SEQ ID NO: 2), EEIVHDG/EEIVL (heavy chain: SEQ ID NO: 13, light chain: SEQ ID NO: 2), and EEIVHEG/EEIVL (heavy chain: SEQ ID NO: 14, light chain: SEQ ID NO: 2), prepared by combining the above heavy chain variants with a natural light chain and introducing a protease cleavage sequence near the boundary between the heavy chain variable region and constant region, and IgG1 antibodies: EEIVH/EEIVLA (heavy chain: SEQ ID NO: 1, light chain: SEQ ID NO: 15), EEIVH/EEIVLB (heavy chain: SEQ ID NO: 1, light chain: SEQ ID NO: 16), EEIVH/EEIVLC (heavy chain: SEQ ID NO: 1, light chain: SEQ ID NO: 17), EEIVH/EEIVLD (heavy chain: SEQ ID NO: 1, light chain: SEQ ID NO: 18), EEIVH/EEIVLE (heavy chain: SEQ ID NO: 1, light chain: SEQ ID NO: 19), EEIVH/EEIVLF (heavy chain: SEQ ID NO: 1, light chain: SEQ ID NO: 20), EEIVH/EEIVLG (heavy chain: SEQ ID NO: 1, light chain: SEQ ID NO: 21), and EEIVH/EEIVLEG (heavy chain: SEQ ID NO: 1, light chain: SEQ ID NO: 22), prepared by combining the above light chain variants with a natural heavy chain and introducing a protease cleavage sequence near the boundary between the light chain variable region and constant region, were transiently expressed using FreeStyle™ 293 (Life Technologies Corp.) according to a method known to those skilled in the art, and purified using protein A according to a method known to those skilled in the art.

Figure 6A:
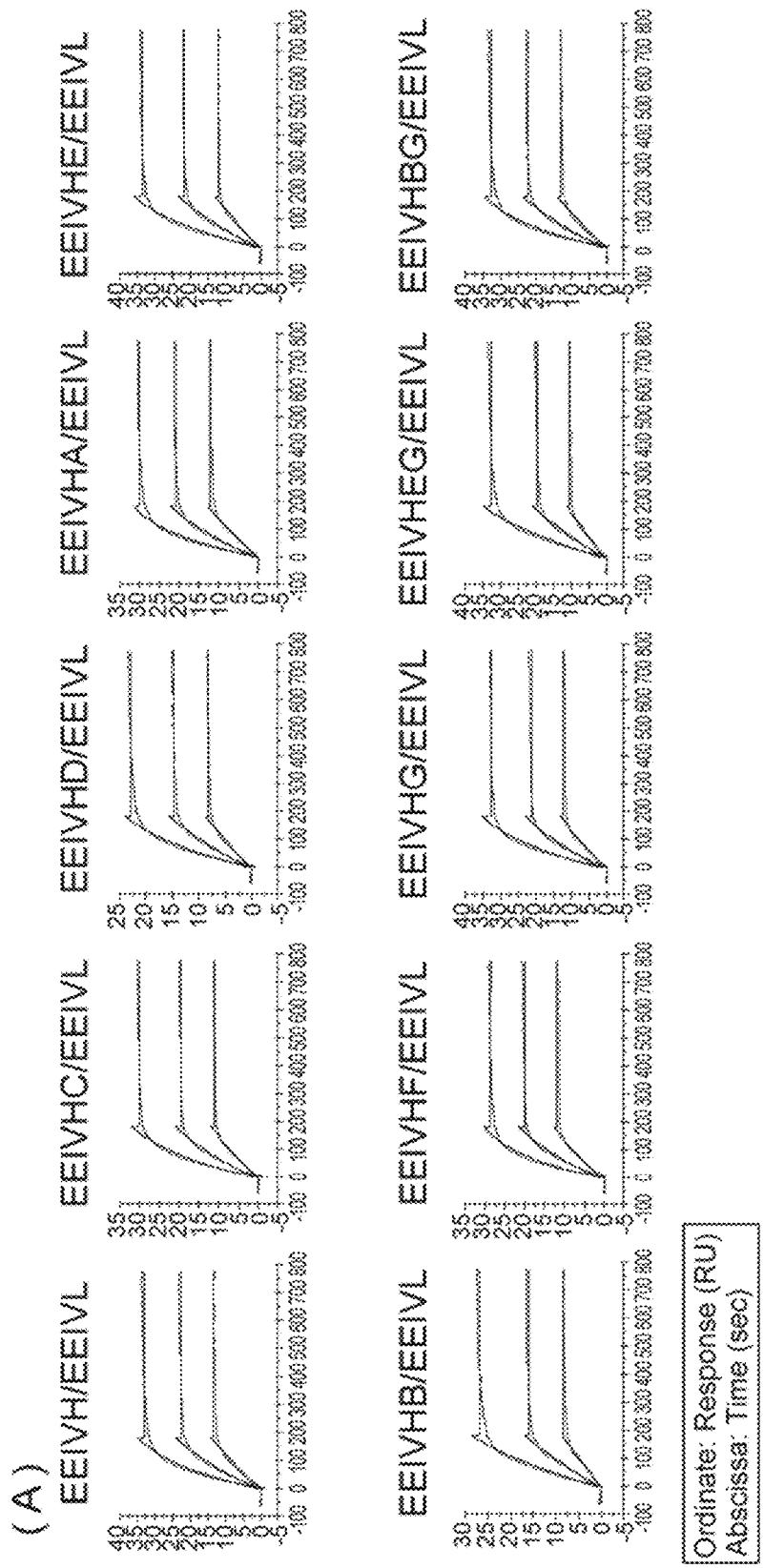
FIG. 6A is a diagram showing results of evaluating the interaction of human CXCL10 with each antibody molecule prepared by inserting a protease cleavage sequence near the boundary between the heavy chain variable region and constant region of MabCXCL10, using Biacore®.
Figure 6B:
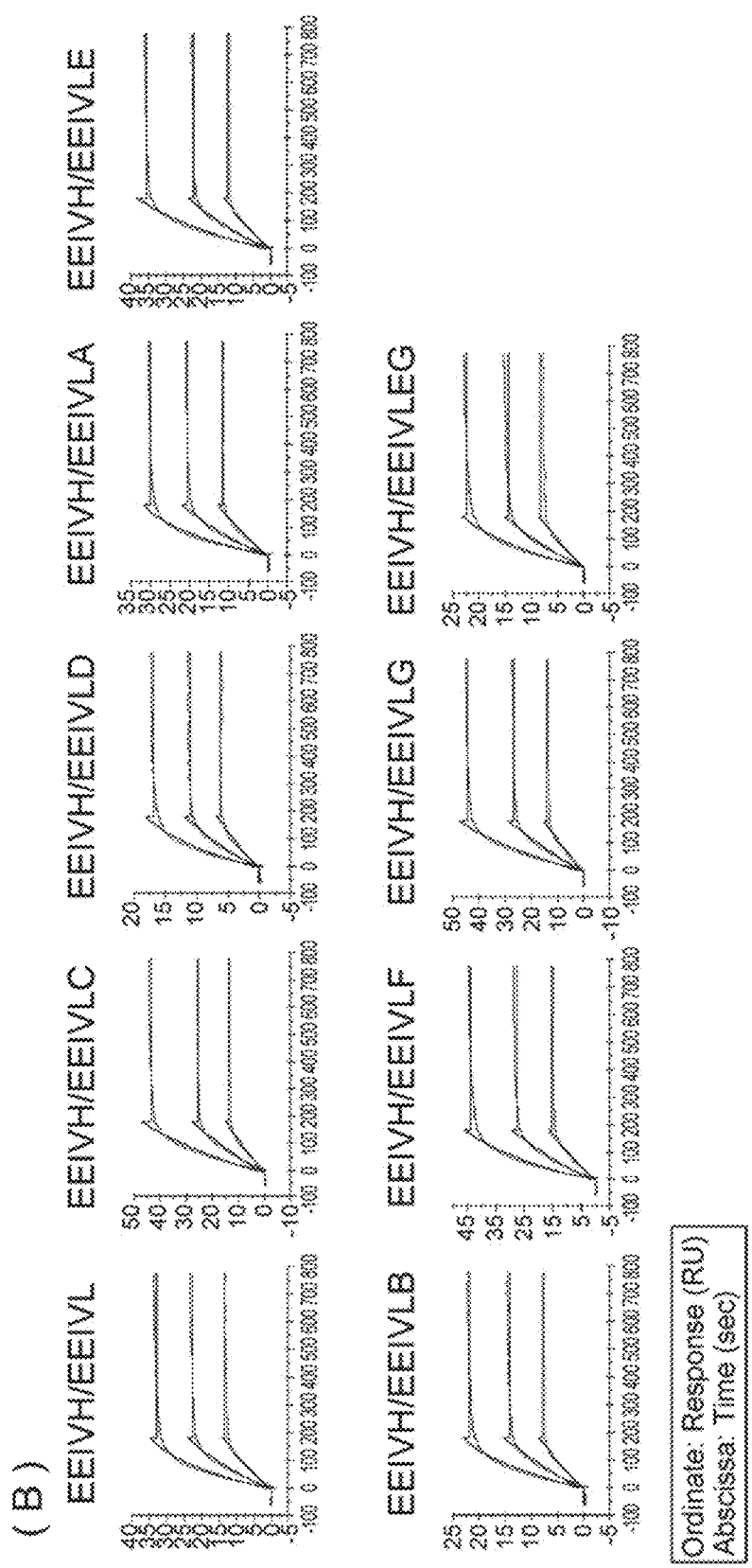
FIG. 6B is a diagram showing results of evaluating the interaction of human CXCL10 with each antibody molecule prepared by inserting a protease cleavage sequence near the boundary between the light chain variable region and constant region of MabCXCL10, using Biacore®.
Figure 7A:
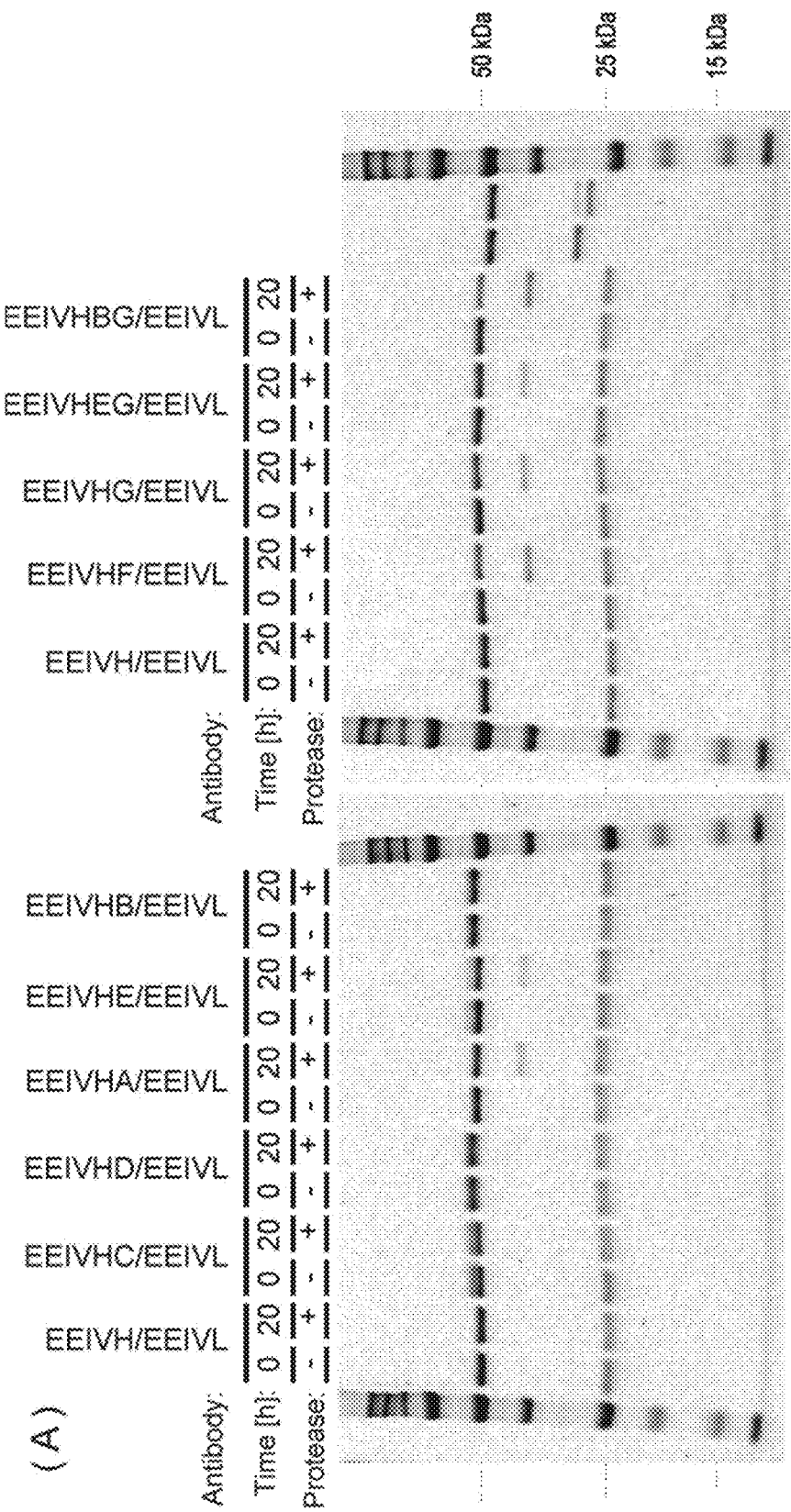
FIG. 7A is a diagram showing (A) results of evaluating the degree of cleavage, comprising treating with protease (MT-SP1) the antibody molecules prepared by inserting a protease cleavage sequence near the boundary between the heavy chain variable region and constant region of MabCXCL10, performing reducing SDS-PAGE electrophoresis, and detecting with Coomassie Brilliant Blue (CBB). Of the two new bands resulting from the protease treatment, the band appearing around 15 kDa is a band derived from the VH, and the band appearing around 25 to 50 kDa is a band derived from the constant region.
Figure 7B:
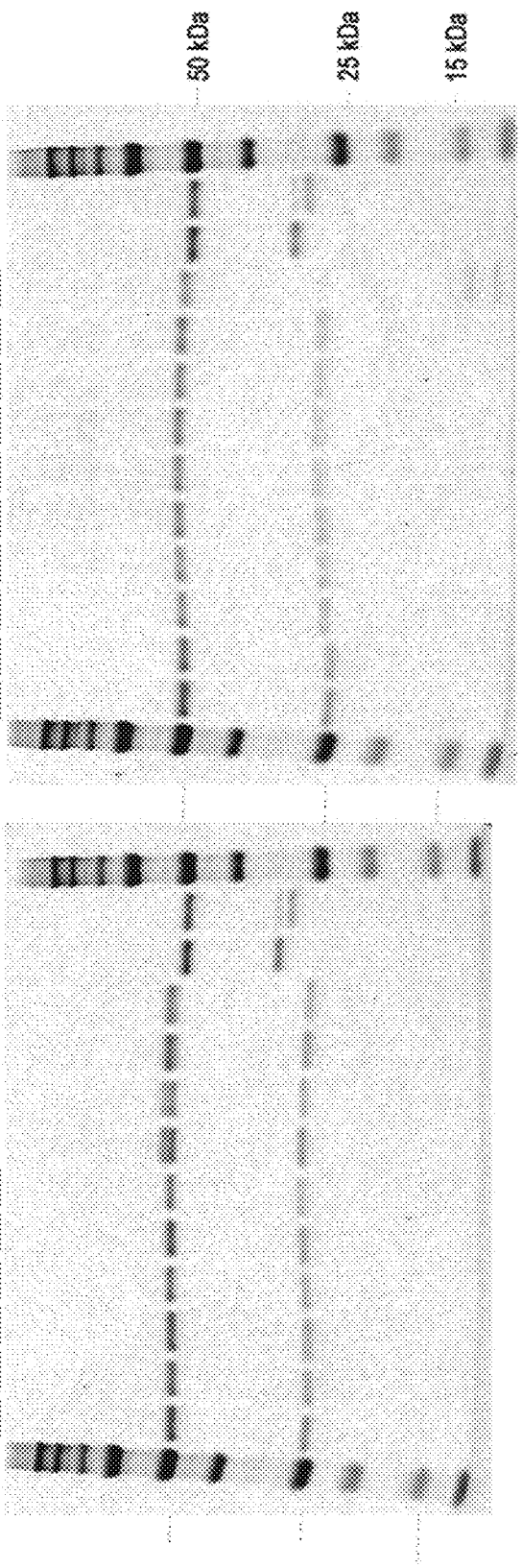
FIG. 7B is a diagram showing a continuation of (A), and showing (B) results of evaluating the degree of cleavage by reducing SDS-PAGE after protease (MT-SP1) treatment of antibody molecules prepared by inserting a protease cleavage sequence into the light chain variable region or constant region of MabCXCL10. The protease treatment generated two new bands derived from the cleaved light chain.
Figure 7C:
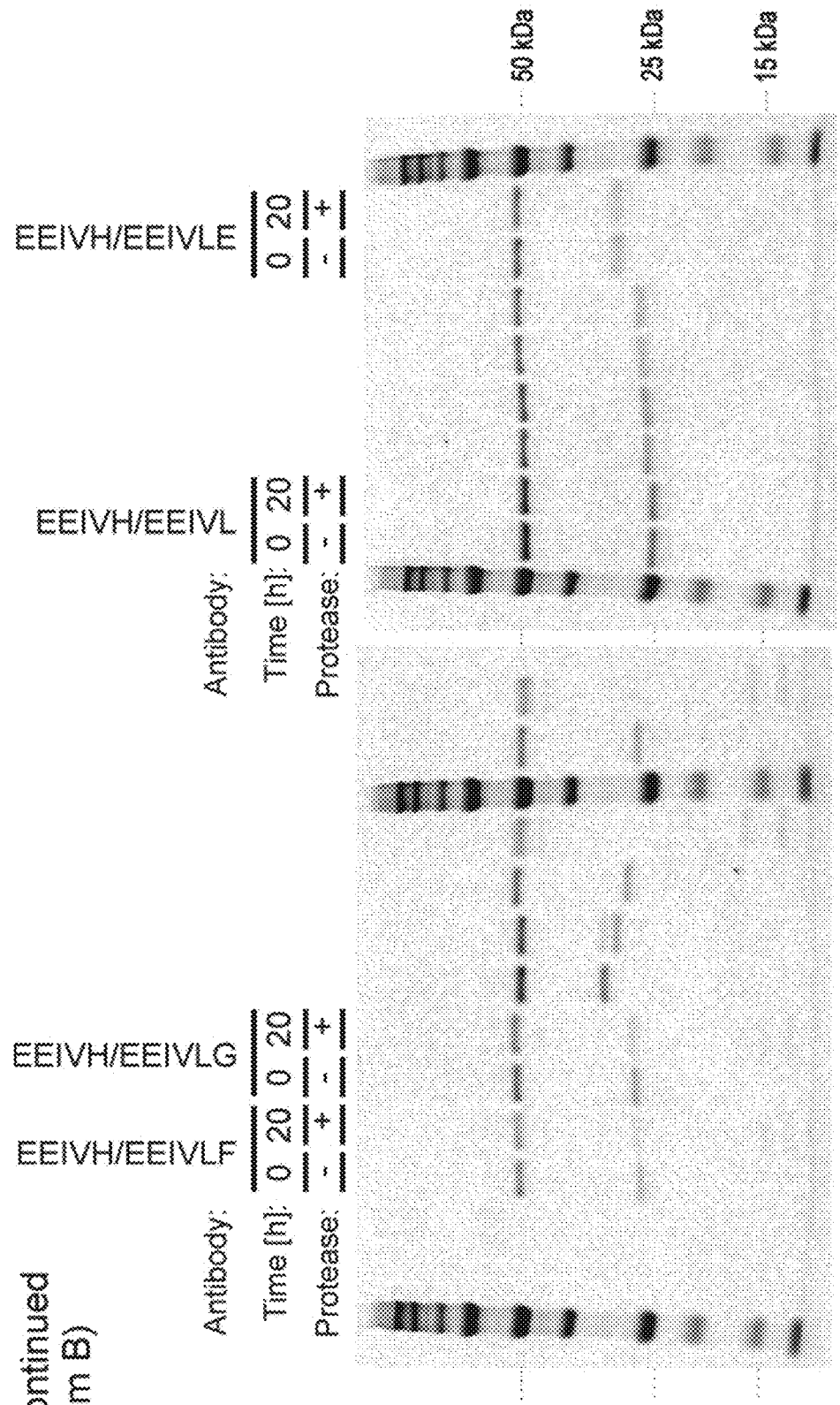
FIG. 7C is a diagram showing a continuation of (B).
Figure 9:
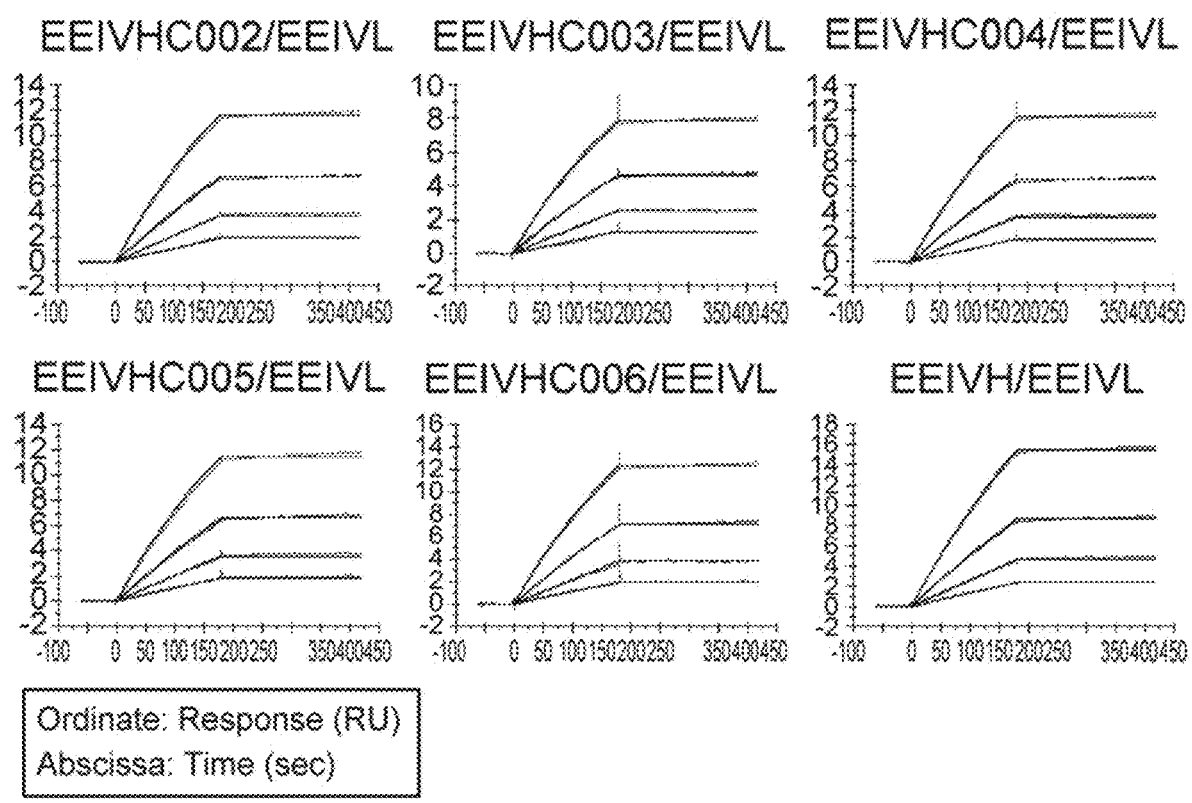
FIG. 9 is a diagram showing results of evaluating the interaction of human CXCL10 with each antibody molecule prepared by inserting a protease cleavage sequence and a flexible linker sequence near the boundary between the heavy chain variable region and constant region of MabCXCL10, using Biacore®.
Figure 10A:
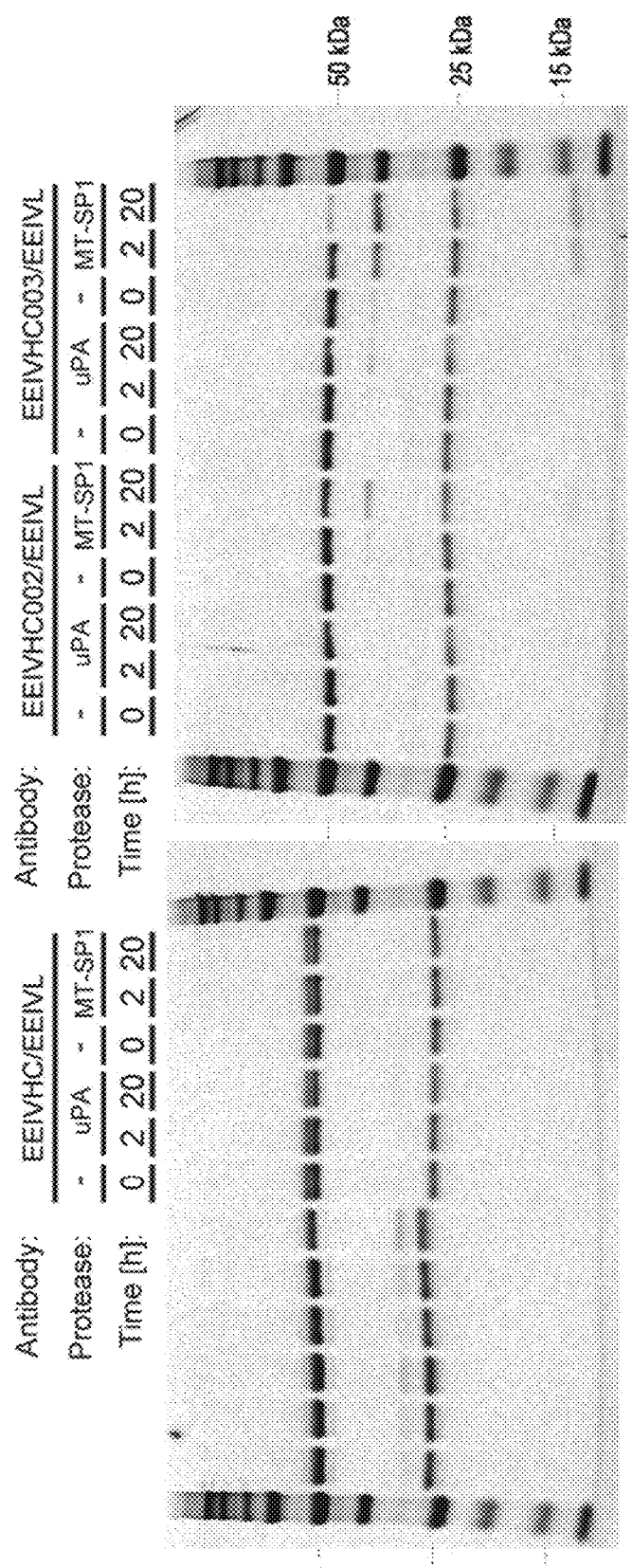
FIG. 10A is a diagram showing results of evaluating the degree of cleavage, comprising treating with protease (uPA or MT-SP1) the antibody molecules prepared by inserting a protease cleavage sequence and a linker sequence near the boundary between the heavy chain variable region and constant region of MabCXCL10, performing reducing SDS-PAGE electrophoresis, and detecting with CBB. Of the two new bands resulting from the protease treatment, the band appearing around 15 kDa is a band derived from the VH, and the band appearing around 25 to 50 kDa is a band derived from the constant region.
Figure 10B:
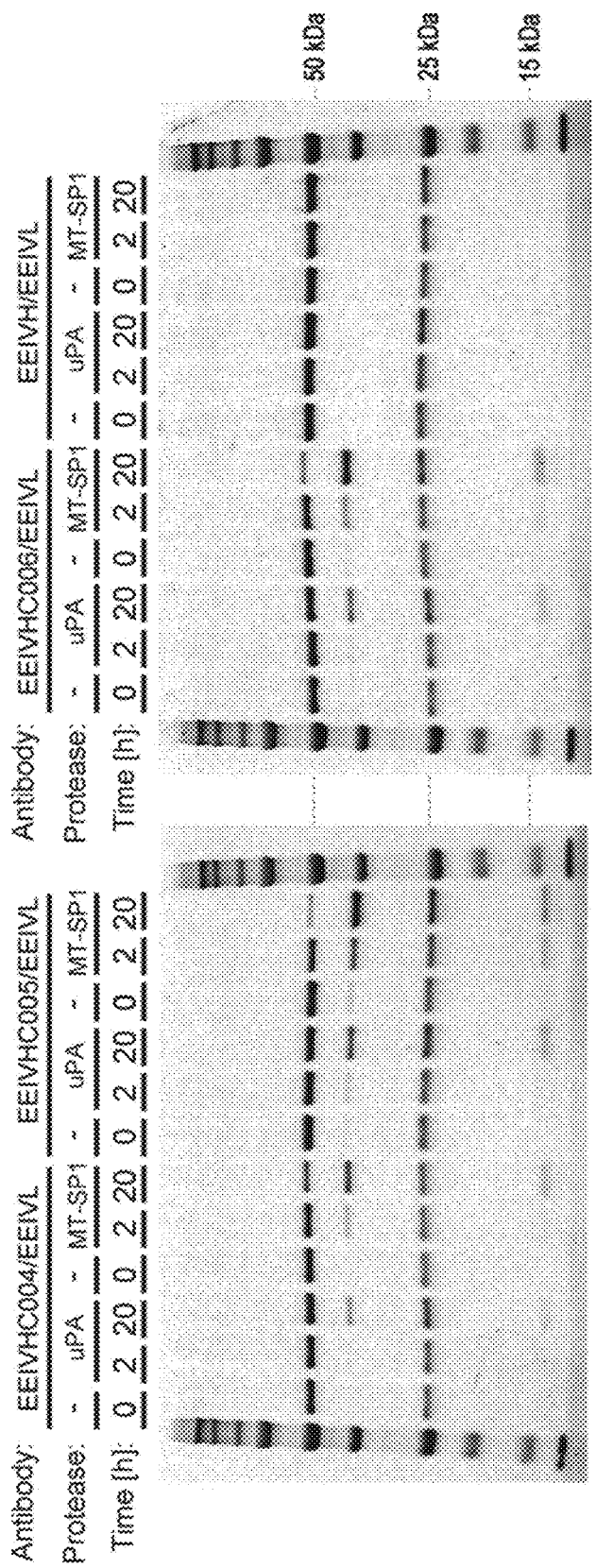
FIG. 10B is a diagram showing a continuation of FIG. 10A.

5-2. Evaluation of Binding Activity of Anti-CXCL10 Neutralizing Antibody with Introduced Protease Cleavage Sequence The antibodies prepared in 5-1 were evaluated for their interaction with human CXCL10 (266-IP-010/CF, R&D Systems, Inc.) using Biacore®. The results are shown in FIG. 6. Specifically, R PROTEIN A (SURE) (28-4018-60, GE Healthcare Japan Corp.) was immobilized onto CM3 sensor chip (BR100536, GE Healthcare Japan Corp.) by the amine coupling method using NHS·EDC. The running buffer used was 20 mM ACES, 0.05% Tween®20, and 150 mM NaCl (pH 7.4). 3.125, 1.563, or 0.781 nM human CXCL10 was applied as an analyte with each antibody captured, and the binding of the antibody to the antigen was evaluated at 25° C. FIG. 6 depicts sensorgrams showing binding amount over time after a blank value using an analyte consisting only of the running buffer was subtracted. The time of starting application of the analyte was plotted as a starting point on the abscissa. When the response at the time of starting application of the analyte was defined as 0, a response (binding amount) at each time point was plotted on the ordinate. As shown in the sensorgrams of FIG. 6, all the antibodies bound to human CXCL10. Thus, the protease cleavage sequence was able to be inserted near the boundary between the antibody variable region and constant region without losing the binding activity to the antigen.

5-3. Evaluation of Protease Cleavage of Anti-CXCL10 Neutralizing Antibody with Introduced Protease Cleavage Sequence Whether the antibodies prepared in 5-1 would be cleaved by protease was verified. Recombinant Human Matriptase/ST14 Catalytic Domain (MT-SP1) (R&D Systems, Inc., 3946-SE-010) was used as the protease. 20 nM protease and 60 or 100 µg/mL of each antibody were reacted in PBS under a condition of 37° C. for 20 hours. Then, cleavage by the protease was evaluated by reducing SDS-PAGE. The results are shown in FIGS. 7A-7C. As a result, the protease treatment of EEIVHA/EEIVL, EEIVHE/EEIVL, EEIVHF/EEIVL, EEIVHG/EEIVL, EEIVHEG/EEIVL, and EEIVHBG/EEIVL generated a new band between 25 kDa and 50 kDa. Furthermore, the protease treatment of EEIVH/EEIVLEG, EEIVH/EEIVLF, and EEIVH/EEIVLG generated a band at 25 kDa or smaller. Thus, the antibodies EEIVHA/EEIVL, EEIVHE/EEIVL, EEIVHF/EEIVL, EEIVHG/EEIVL, EEIVHEG/EEIVL, EEIVHBG/EEIVL, EEIVH/EEIVLEG, EEIVH/EEIVLF, and EEIVH/EEIVLG were confirmed to be cleaved by protease.

5-4. Introduction of Flexible Linker Sequence in Vicinity of Protease Cleavage Sequence in Anti-CXCL10 Neutralizing Antibody with an Introduced Protease Cleavage Sequence Study was conducted to insert a sequence containing a linker consisting of a glycine-serine polymer in the vicinity of the protease cleavage sequence of EEIVHC/EEIVL (that did not undergo the cleavage by recombinant Human Matriptase/ST14 (MT-SP1) Catalytic Domain (R&D Systems, Inc., 3946-SE-010) in 5-3. Five types of heavy chains shown in FIG. 8 were designed. Expression vectors encoding the heavy chain variants EEIVHC002 (SEQ ID NO: 23), EEIVHC003 (SEQ ID NO: 24), EEIVHC004 (SEQ ID NO: 25), EEIVHC005 (SEQ ID NO: 26), and EEIVHC006 (SEQ ID NO: 27) were prepared by a method known to those skilled in the art.

IgG1 antibodies: EEIVHC002/EEIVL (heavy chain: SEQ ID NO: 23, light chain: SEQ ID NO: 2), EEIVHC003/EEIVL (heavy chain: SEQ ID NO: 24, light chain: SEQ ID NO: 2), EEIVHC004/EEIVL (heavy chain: SEQ ID NO: 25, light chain: SEQ ID NO: 2), EEIVHC005/EEIVL (heavy chain: SEQ ID NO: 26, light chain: SEQ ID NO: 2), and EEIVHC006/EEIVL (heavy chain: SEQ ID NO: 27, light chain: SEQ ID NO: 2), prepared by combining these heavy chain variants with a natural light chain and inserting a protease cleavage sequence near the boundary between the heavy chain variable region and constant region, were transiently expressed using FreeStyle™ 293 (Life Technologies Corp.) according to a method known to those skilled in the art, and purified using protein A according to a method known to those skilled in the art.

5-5. Evaluation of Binding Activity of Anti-CXCL10 Neutralizing Antibody with Introduced Protease Cleavage Sequence and Flexible Linker Sequence The antibodies prepared in 5-4 were evaluated for their interaction with human CXCL10 (266-IP-010/CF, R&D Systems, Inc.) using Biacore®. The results are shown in FIG. 9. Specifically, R PROTEIN A (SURE) (28-4018-60, GE Healthcare Japan Corp.) was immobilized onto CM3 sensor chip (BR 100536, GE Healthcare Japan Corp.) by the amine coupling method using NHS·EDC. The running buffer used was 20 mM ACES, 0.05% Tween®20, and 300 mM NaCl (pH 7.4). 6.25, 3.125, 1.563, or 0.781 nM human CXCL10 was applied thereto as an analyte with each antibody captured, and the binding of the antibody to the antigen was evaluated at 25° C. FIG. 9 depicts sensorgrams showing binding amount over time after blank value using an analyte consisting only of the running buffer was subtracted. The time of starting application of the analyte was plotted as a starting point on the abscissa. When the response at the time of starting application of the analyte was defined as 0, a response (binding amount) at each time point was plotted on the ordinate. As shown in the sensorgrams of FIG. 9, all the antibodies bound to the human CXCL10. Thus, the protease cleavage sequence and the flexible linker sequence were able to be inserted near the boundary between the antibody variable region and constant region without losing the binding activity to the antigen.

5-6. Evaluation of Protease Cleavage of Anti-CXCL10 Neutralizing Antibody with Introduced Protease Cleavage Sequence and Flexible Linker Sequence Whether the antibodies prepared in 5-5 would be cleaved by protease was verified. Human urokinase (uPA) (R&D Systems, Inc., 1310-SE-010) or recombinant Human Matriptase/ST14 Catalytic Domain (MT-SP1) (R&D Systems, Inc., 3946-SE-010) was used as the protease. 12.5 nM protease and 133 µg/mL of each antibody were reacted in PBS under a condition of 37° C. for 2 or 20 hours. Then, cleavage by the protease was evaluated by reducing SDS-PAGE. The results are shown in FIG. 10. As a result, the protease treatment of EEIVHC002/EEIVL (heavy chain: SEQ ID NO: 23, light chain: SEQ ID NO: 2), EEIVHC003/EEIVL (heavy chain: SEQ ID NO: 24, light chain: SEQ ID NO: 2), EEIVHC004/EEIVL (heavy chain: SEQ ID NO: 25, light chain: SEQ ID NO: 2), EEIVHC005/EEIVL (heavy chain: SEQ ID NO: 26, light chain: SEQ ID NO: 2), and EEIVHEC006/EEIVL generated a new band between 25 kDa and 50 kDa. Thus, the antibodies EEIVHC002/EEIVL, EEIVHC003/EEIVL (heavy chain: SEQ ID NO: 24, light chain: SEQ ID NO: 2), EEIVHC004/EEIVL (heavy chain: SEQ ID NO: 25, light chain: SEQ ID NO: 2), EEIVHC005/EEIVL (heavy chain: SEQ ID NO: 26, light chain: SEQ ID NO: 2), and EEIVHEC006/EEIVL were confirmed to be cleaved by protease.

These results demonstrated that even an antibody, such as EEIVHC/EEIVL, which does not undergo protease cleavage when a protease cleavage site alone is introduced near the boundary between variable and constant regions, can be prepared into a protease-cleavable molecule by introducing a flexible linker sequence in the vicinity of the cleavage sequence. The results described above demonstrated that an antibody that undergoes protease cleavage can also be prepared by arbitrarily combining a protease cleavage sequence with a flexible linker.

5-7. Ligand Activation by Protease Cleavage of CXCL10-Anti-CXCL10 Neutralizing Antibody Whether human CXCL10 bound with the antibody prepared in 5-5 would be released by protease treatment was then evaluated using Biacore®. Specifically, the antibody EEIVHC006a/EEIVL (heavy chain: SEQ ID NO: 33, light chain: SEQ ID NO: 2) prepared in 5-5 was used to provide an antigen (+)/protease (+) analyte, an antigen (−)/protease (+) analyte, and an antigen (+)/protease (−) analyte. The antigen (+)/protease (+) analyte used was prepared by binding the antibody with human CXCL10 and then treating with 20 nM recombinant Human Matriptase/ST14 Catalytic Domain (MT-SP1) (R&D Systems, Inc., 3946-SE-010) for 20 hours. The antigen (−)/protease (+) analyte used was prepared by treating the antibody alone by 20 nM recombinant Human Matriptase/ST14 Catalytic Domain (MT-SP1) (R&D Systems, Inc., 3946-SE-010) for 20 hours. The antigen (+)/protease (−) analyte used was prepared by binding the antibody with human CXCL10. As a control system for confirming that the responses resulted from the binding of CXCL10, CXCL10 was also provided as an analyte consisting only of the antigen. An anti-CXCL10 antibody was immobilized onto CM5 sensor chip (BR100530, GE Healthcare Japan Corp.) according to a method known to those skilled in the art. The running buffer used was 20 mM ACES and 0.05% Tween®20 (pH 7.4). Four types of analytes, i.e., the antigen (+)/protease (+) analyte, the antigen (−)/protease (+) analyte, the antigen (+)/protease (−) analyte, and the antigen only analyte, were each applied, and the binding of the human CXCL10 to the anti-CXCL10 antibody on the sensor chip was evaluated at 25° C. MabCXCL10a (heavy chain: EEIVHa (SEQ ID NO: 65), light chain: EEIVL (SEQ ID NO: 2)) having the same Fab region as that of the antibody MabCXCL10 having no protease cleavage sequence was used to provide an antigen (+)/protease (+) analyte, an antigen (−)/protease (+) analyte, and an antigen (+)/protease (−) analyte in the same way as in the antibody EEIVHC006a/EEIVL. Similarly, an anti-CXCL10 antibody was immobilized onto CM5 sensor chip (BR100530, GE Healthcare Japan Corp.) according to a method known to those skilled in the art. The running buffer used was 20 mM ACES and 0.05% Tween®20 (pH 7.4). Four types of analytes, i.e., the antigen (+)/protease (+) analyte, the antigen (−)/protease (+) analyte, the antigen (+)/protease (−) analyte, and the antigen only analyte (CXCL10), were each applied, and the binding of the human CXCL10 to the anti-CXCL10 antibody on the sensor chip was evaluated at 25° C.

Figure 11B:
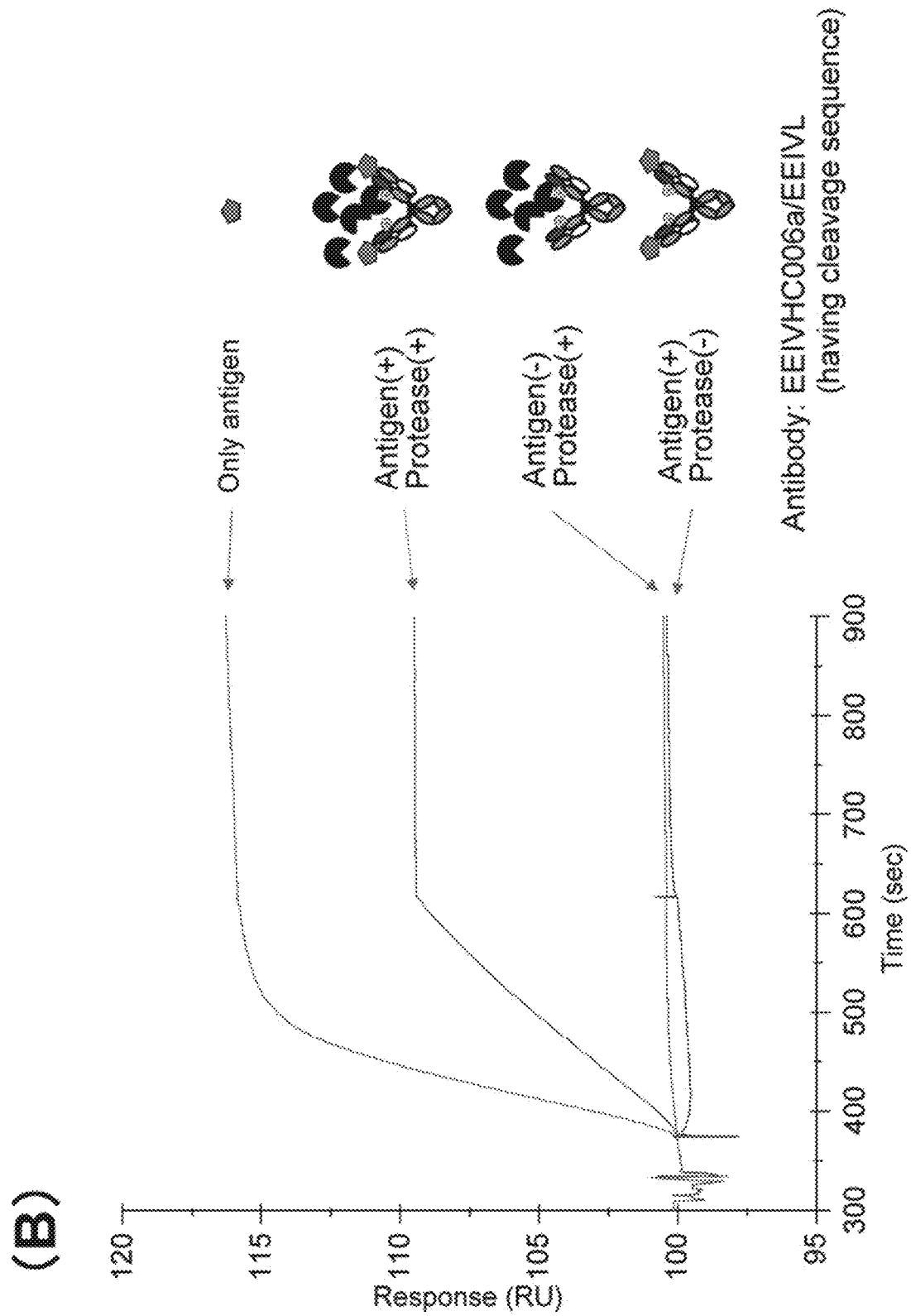
FIG. 11B is a diagram showing results of evaluating whether CXCL10 would be released by the protease (MT-SP1) treatment of a complex of EEIVHC006a/EEIVL and CXCL10.
Figure 13:
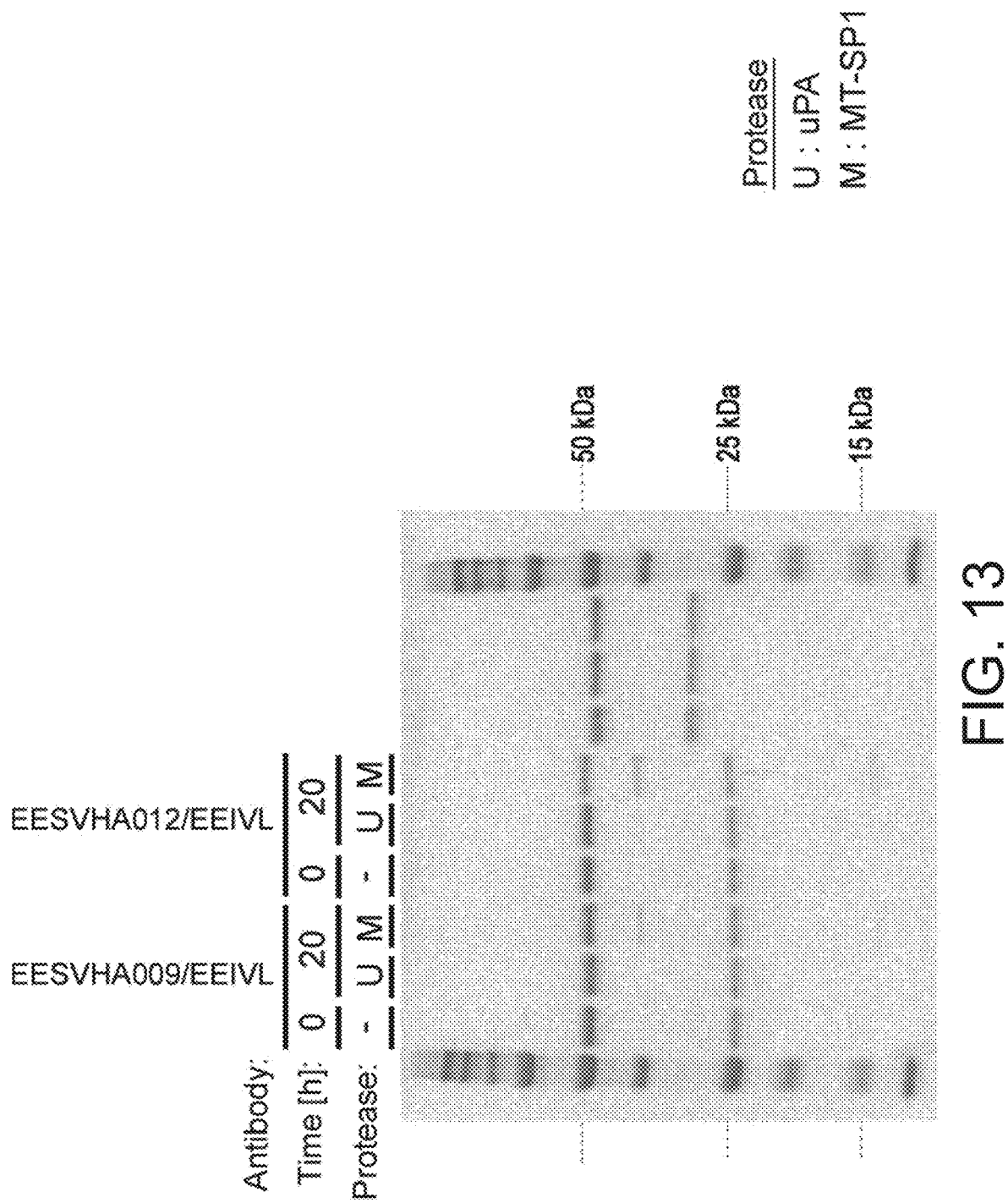
FIG. 13 is a diagram showing results of evaluating the degree of cleavage, comprising treating with protease (uPA or MT-SP1) the antibody molecules prepared by substituting a portion of an amino acid sequence near the boundary between the variable region and constant region of MabCXCL10 with a protease cleavage sequence and a flexible linker, performing reducing SDS-PAGE electrophoresis, and detecting with CBB. Of the two new bands resulting from the protease treatment, the band appearing around 15 kDa is a band derived from the VH, and the band appearing around 25 to 50 kDa is a band derived from the constant region.
Figure 14:
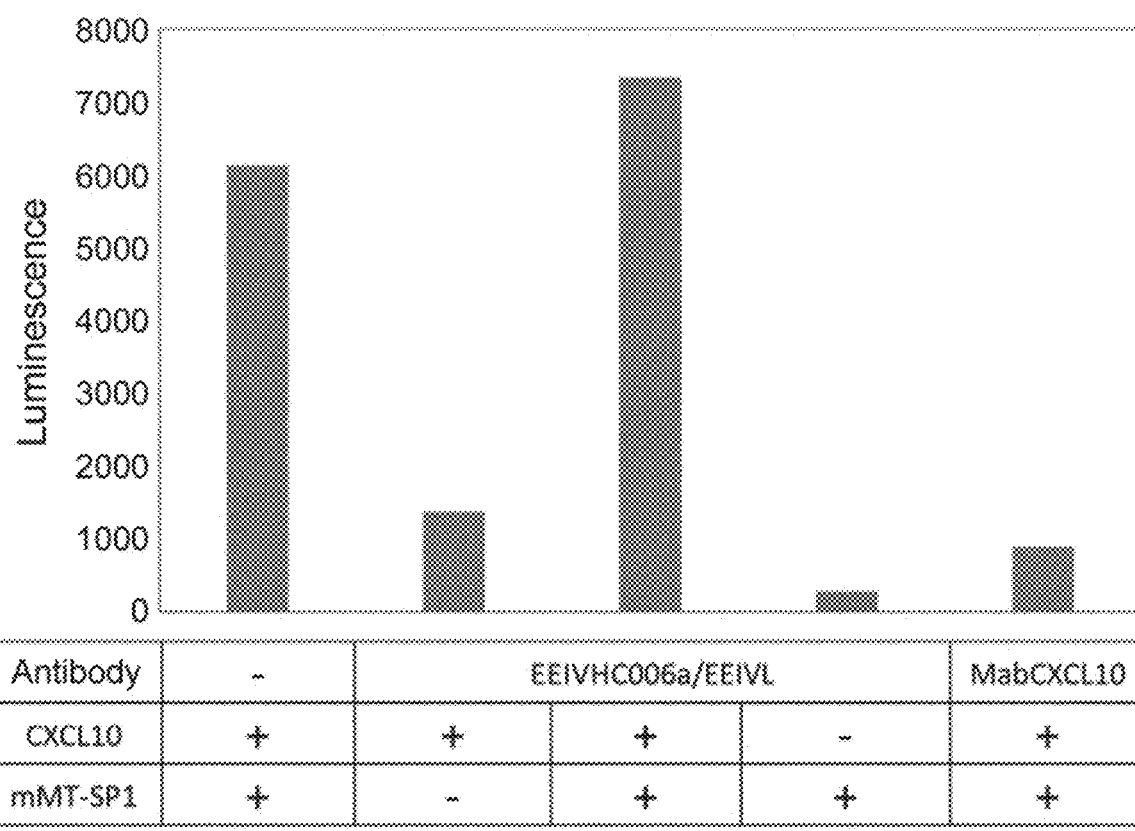
FIG. 14 is a diagram showing luciferase activity (luminescence intensity).

FIG. 11 depicts sensorgrams showing binding amount over time after subtracting the value of flow cells where anti-CXCL10 antibody was not immobilized. The time of starting application of the analyte was plotted as a starting point on the abscissa. When the response at the time of starting application of the analyte was defined as 100, a response at each time point was plotted on the ordinate. As a result, as shown in FIG. 11(A), CXCL10 was not released by the protease treatment of MabCXCL10a with no introduced cleavage sequence. By contrast, as shown in FIG. 11(B), CXCL10 was confirmed to be released by the protease treatment of EEIVHC006a/EEIVL.

5-8. Preparation of Anti-CXCL10 Neutralizing Antibody by Replacing a Portion of Amino Acid Sequence Near Boundary Between Antibody Variable Region and Constant Region with a Portion of Protease Cleavage Sequence and Flexible Linker Sequence, and Evaluation of Protease Cleavage Study was conducted to replace a portion of the amino acid sequence near the boundary between the heavy chain variable region and constant region of MabCXCL10 with a portion of a protease cleavage sequence and a flexible linker sequence. Heavy chains shown in FIG. 12 were designed such that partial amino acids of the heavy chains were replaced with peptide sequence A (SEQ ID NO: 3), which is reportedly cleavable by urokinase (uPA) and matriptase (MT-SP1), which are expressed specifically in cancer. Expression vectors encoding the heavy chain variants EESVHA009 (SEQ ID NO: 59) and EESVHA012 (SEQ ID NO: 60) were prepared according to a method known to those skilled in the art.

IgG1 antibodies: EESVHA009/EEIVL (heavy chain: SEQ ID NO: 59, light chain: SEQ ID NO: 2) and EESVHA012/EEIVL (heavy chain: SEQ ID NO: 60, light chain: SEQ ID NO: 2), prepared by combining these heavy chain variants with a natural light chain, were transiently expressed using FreeStyle™ 293 (Life Technologies Corp.) according to a method known to those skilled in the art, and purified using protein A according to a method known to those skilled in the art.

Whether EESVHA009/EEIVL and EESVHA012/EEIVL would be cleaved by protease was verified. Human urokinase (uPA) (R&D Systems, Inc., 1310-SE-010) or recombinant Human Matriptase/ST14 Catalytic Domain (MT-SP1) (R&D Systems, Inc., 3946-SE-010) was used as the protease. 12.5 nM protease and 100 μg/mL of each antibody were reacted in PBS under a condition of 37° C. for 20 hours. Then, cleavage by the protease was evaluated by reducing SDS-PAGE. The results are shown in FIG. 13. As a result, the protease treatment of EESVHA009/EEIVL and EESVHA012/EEIVL generated a new band between 25 kDa and 50 kDa. Thus, the antibodies EESVHA009/EEIVL and EESVHA012/EEIVL were confirmed to be cleaved by protease.

Example 6 Discussion on Acceptable Site for Insertion of Cleavage Sequence for Eliminating Antigen Binding Capacity by Protease Cleavage There is a report on the preparation and in vitro functional evaluation of an antibody with a protease cleavage sequence inserted immediately before aspartic acid at position 216 in the heavy chain of a human IgG1 antibody (International Publication No. WO2004/021861A2). The report does not describe experimental data, but asserts that mixing of this antibody with its antigen followed by treatment with a medium containing appropriate protease resulted in release of the antigen from the antigen-antibody complex. The amino acid at position 216 in the heavy chain of a human IgG1 antibody, into which the protease cleavage sequence was inserted as the report asserts, is not aspartic acid in any of the Kabat numbering, EU numbering, and OU numbering systems described in Kabat, E. et al., Sequences of Proteins of Immunological Interest 5th edition. On the other hand, with reference to other literatures (Nature 344, 667-670 (12 Apr. 1990); and Kabat, E. et al. Sequences of Proteins of Immunological Interest 4th edition), amino acid position 216 in the heavy chain of a human IgG1 antibody seems to be aspartic acid positioned immediately after cysteine forming a disulfide bond between the heavy and light chains. In the case of inserting the protease cleavage sequence immediately before this aspartic acid at position 216, the resulting antibody that has undergone protease cleavage is considered to form the same Fab regions as those when the antibody hinge region is cleaved by papain. It is generally recognized that the papain cleavage of the antibody hinge region is unlikely to abolish the antigen binding capacity. Hence, it is considered that this antibody with a protease cleavage sequence inserted immediately before aspartic acid at position 216 does not lose its antigen binding capacity even if cleaved by appropriate protease.

Discussion will also be made on the case where the protease cleavage sequence is inserted immediately before amino acid position 216 (Kabat numbering) in the heavy chain of a human IgG1 antibody defined by the Kabat numbering described in Kabat, E. et al., Sequences of Proteins of Immunological Interest 5th edition. This site exists on the N-terminal side by several amino acids with respect to cysteine at position 220 (Kabat numbering) forming a disulfide bond between the heavy and light chains. Therefore, the influence of protease cleavage of the heavy chain at this site is presumably similar to the influence of deletion of the disulfide bond formed between the heavy and light chains. From the past reference, even a Fab region incapable of forming a disulfide bond between the heavy and light chains is unlikely to lose its antigen binding (MAbs. 2014 January-February; 6 (1): 204-18). Hence, it is considered that the antibody does not lose its antigen binding capacity by protease cleavage even if the protease cleavage sequence is inserted immediately before amino acid position 216 (Kabat numbering) in the heavy chain of a human IgG1 antibody defined by the Kabat numbering described in Kabat, E. et al., Sequences of Proteins of Immunological Interest 5th edition.

Example 7 Evaluation of Chemotactic Activity Associated with Protease Cleavage of a Complex of CXCL10/Anti-CXCL10 Neutralizing Antibody with an Introduced Protease Cleavage Sequence Whether a complex formed by CXCL10 and the CXCL10 neutralizing antibody with an introduced protease cleavage sequence as prepared in Example 5 would release the CXCL10 by protease cleavage so that the CXCL10 would exert cell migration activity, was evaluated.

The cell migration activity of CXCL10 was evaluated by preparing Ba/F3 transfectant cells expressing mouse CXCR3 (mCXCR3) (hereinafter, referred to as BaF3/mCXCR3) and using these cells and HTS Transwell™-96 Permeable Support with 5.0 μm Pore Polycarbonate Membrane (Cat. 3387, Corning Inc.). Five types of analytes were provided: CXCL10+protease, EEIVHC006a/EEIVL+CXCL10, EEIVHC006a/EEIVL+CXCL10+protease, EEIVHC006a/EEIVL+protease, and MabCXCL10+CXCL10+protease.

Either 10 μg/mL (final concentration) of each antibody (MabCXCL10 or EEIVHC006a/EEIVL) or 100 ng/ml (final concentration) of hCXCL10 (Cat. 300-12, PeproTech, Inc.), or both the antibody and hCXCL10 were placed in Proteosave SS 1.5 mL microtube (Cat. MS-4265M, Sumitomo Bakelite Co., Ltd.) and left at ordinary temperature for 30 minutes. For the analytes with protease, mouse MT-SP1 (mMT-SP1, Cat. 4735-SE-010, R&D Systems, Inc.) was further added thereto after the reaction, to achieve a final concentration of 12.5 nM.

235 μL of each analyte was transferred to the lower chamber, and $2.0\times10^5$ cells/well of the BaF3/mCXCR3 cells were inoculated at 75 μL/well to the upper chamber, followed by reaction for 6 hours. The reaction was performed under conditions involving 5% $CO_2$ and 37° C. After the 6-hour reaction, 100 μL of the solution in the lower chamber was transferred to Fluorescence Luminescence 96-well plate (Cat. 3912, Corning Inc.), and 100 μL of CellTiter-Glo™ Luminescent Cell Viability Assay solution (Cat. G7571, Promega Corp.) was added thereto. After reaction at room temperature for 10 minutes, luminescence value was measured using SpectraMax M3 multimode microplate reader (Molecular Devices, LLC) to evaluate the degree of cell migration to the lower chamber. The results are shown in FIG. 14.

The luminescence intensity was decreased by the addition of the EEIVHC006a/EEIVL+CXCL10 analyte as compared with the CXCL10+protease analyte. The luminescence intensity reflects the amount of cell that have migrated. Hence, EEIVHC006a/EEIVL was found to form a complex with CXCL10 and neutralize the effect of the CXCL10. On the other hand, the luminescence intensity recovered by the addition of the EEIVHC006a/EEIVL+CXCL 10+protease analyte compared with the addition of the EEIVHC006a/EEIVL+CXCL10 analyte, demonstrating that the addition of this analyte caused cell migration as in the addition of the CXCL10+protease analyte. No recovery was seen in luminescence intensity when the MabCXCL10+CXCL10+protease analyte containing the MabCXCL10 antibody having no cleavage sequence was added. This result demonstrated that the ability of EEIVHC006a/EEIVL to neutralize CXCL10 is reduced in association with the protease cleavage of the antibody.

Example 8 Evaluation of Migration Activity Associated with Protease Cleavage of an Anti-CXCL10 Neutralizing Antibody-CXCL10 Fusion Protein with an Introduced Protease Cleavage Sequence 8-1. Production of an Anti-CXCL10 Neutralizing Antibody-CXCL10 Fusion Protein with an Introduced Protease Cleavage Sequence, and Evaluation of its Protease Cleavage The light chain of MabCXCL10_G7 (heavy chain: G7H-GIT4 (SEQ ID NO: 368), light chain: G7L-LT0 (SEQ ID NO: 369)), a neutralizing antibody against human CXCL10, was used. A human CXCL10 variant, hCXCL10R75A (SEQ ID NO: 370), which was mutated to be protease-resistant, was linked to the N-terminus of this light chain to construct a ligand-fused light chain, hCXCL10R75A.G4SGGGG.G7L-LT0 (SEQ ID NO: 371). In addition, a sequence (SEQ ID NO: 338) that can be cleaved by urokinase (uPA) and matriptase (MT-SP1), which are expressed specifically in cancer, was inserted near the boundary between the antibody variable region and the antibody constant region in hCXCL10R75A.G4SGGGG.G7L-LT0 to construct a ligand-fused light chain, hCXCL10R75A.G7L.12aa0054-LT0 (SEQ ID NO: 372). These ligand-fused light chains were combined with G7H-GIT4, the heavy chain of MabCXCL10_G7. The fusion proteins G7H-G1T4/hCXCL10R75A.G4SGGGG.G7L-LT0 (heavy chain SEQ ID NO: 368, ligand-fused light chain SEQ ID NO: 371) and G7H-GIT4/hCXCL10R75A.G7L.12aa0054-LT0 (heavy chain SEQ ID NO: 368, ligand-fused light chain SEQ ID NO: 372) were transiently expressed using Expi293™ (Life Technologies) according to a method known to those skilled in the art, and purified using Protein A according to a method known to those skilled in the art. The CDR sequences of MabCXCL10_G7 are as follows: H-CDR1 (SFSIT, SEQ ID NO: 374), H-CDR2 (EITPMFGIANYAQKFQG, SEQ ID NO: 375), H-CDR3 (DGRFDVSDLLTDKPKVTINYN-GMDV, SEQ ID NO: 376), L-CDR1 (SGSSSNIGSNTVN, SEQ ID NO: 377), L-CDR2 (NNDQRPS, SEQ ID NO: 378), L-CDR3 (ASWDDSLNGRV, SEQ ID NO: 379).

Figure 15:
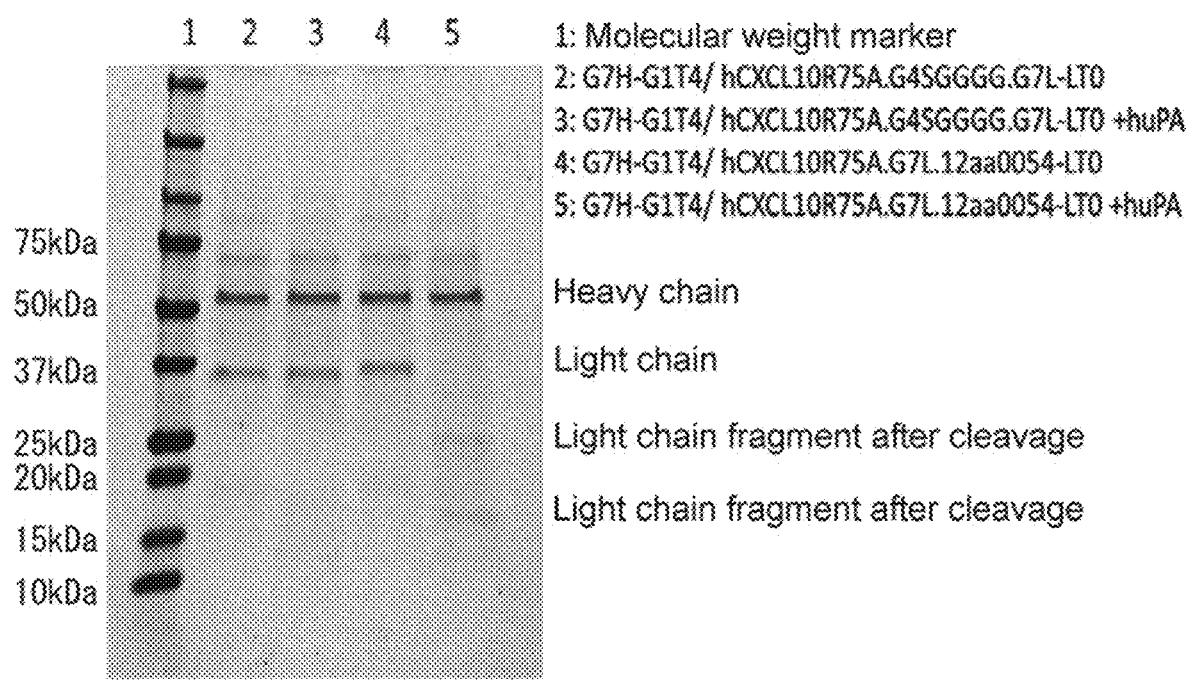
FIG. 15 shows results of SDS-PAGE before and after protease cleavage of a CXCL10-anti-CXCL10 antibody fusion protein.
Figure 16:
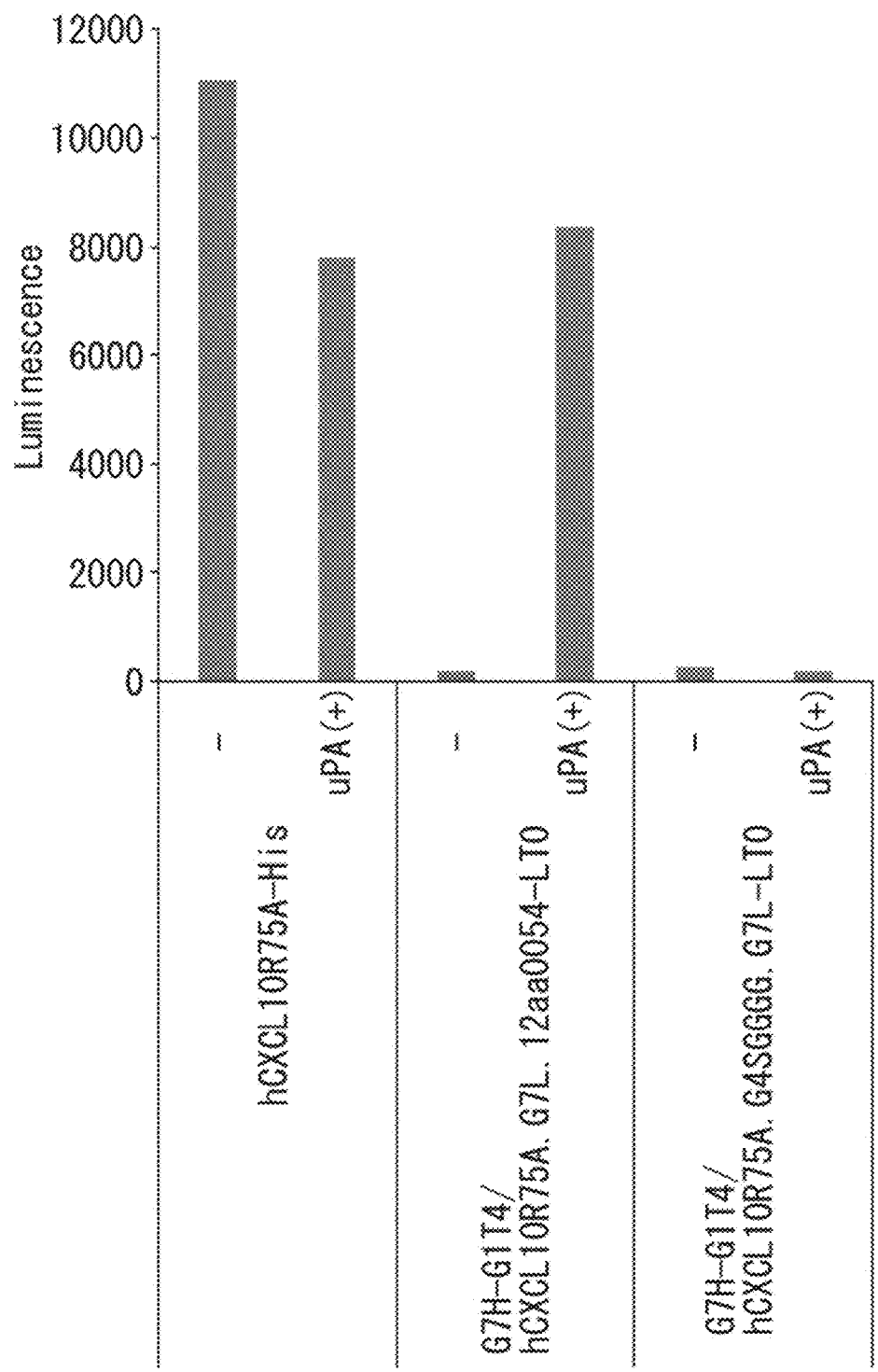
FIG. 16 is a diagram showing luciferase activity (luminescence intensity).
Figure 17:
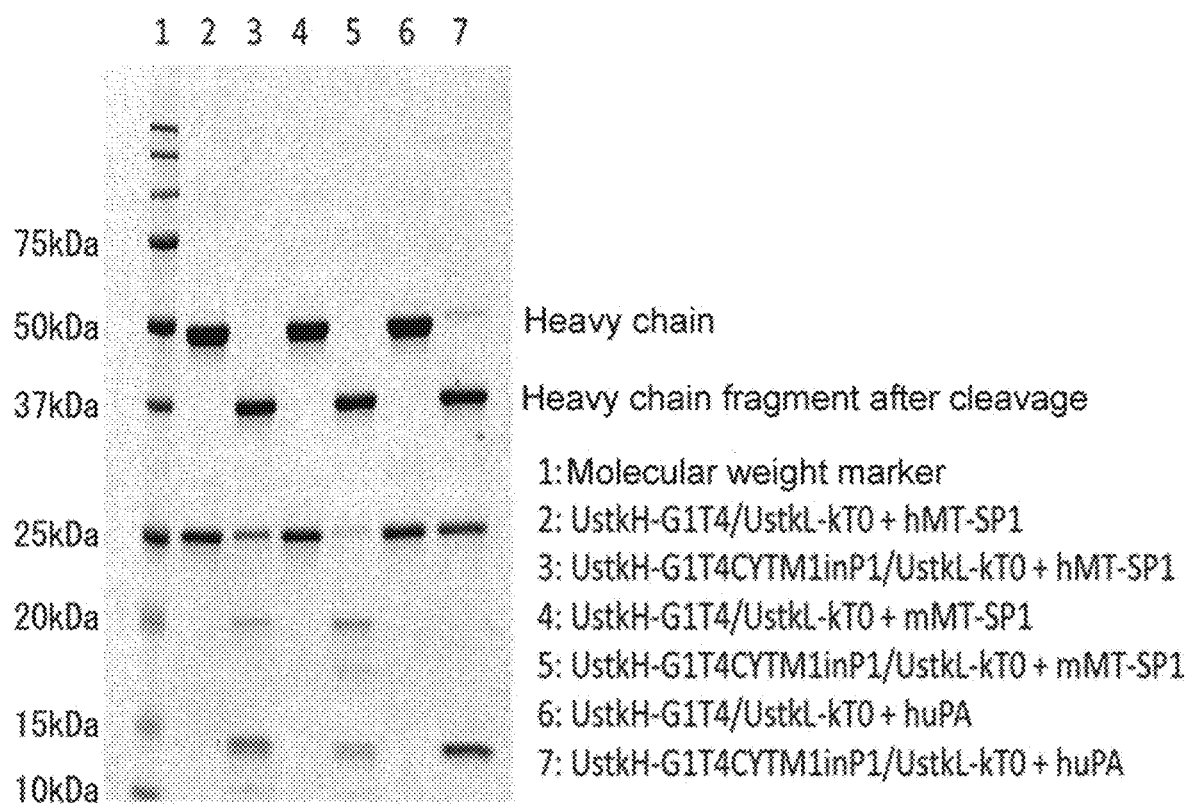
FIG. 17 is a diagram showing reducing SDS-PAGE results of evaluating the protease cleavage of anti-IL-12 neutralizing antibodies with an introduced protease cleavage sequence and a flexible linker sequence.
Figure 18:
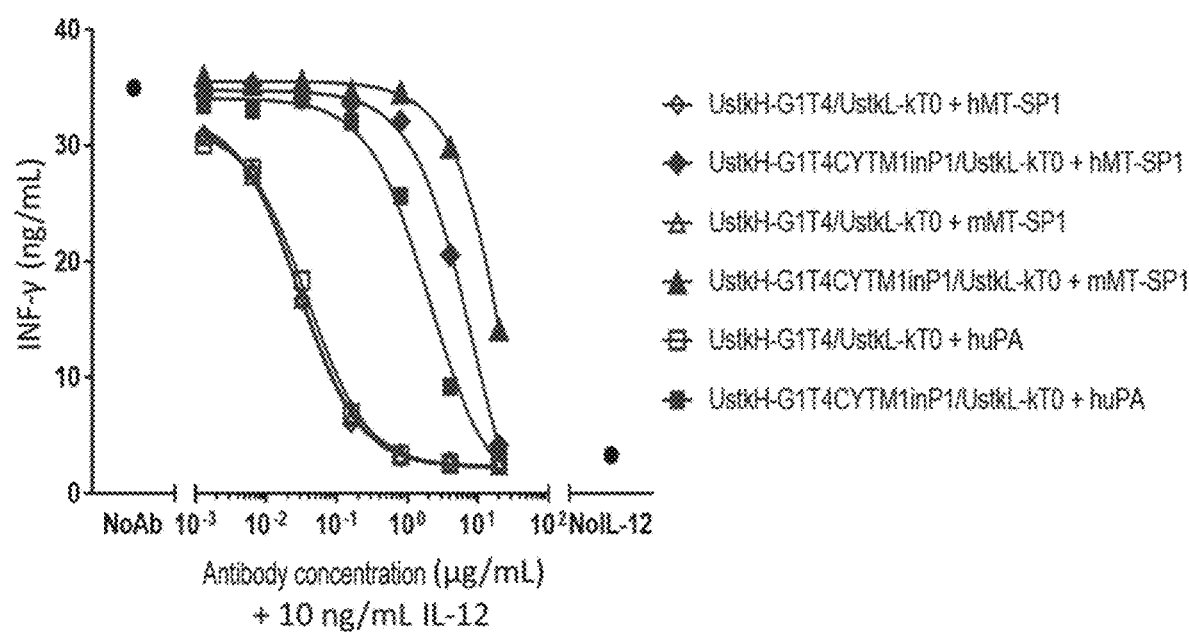
FIG. 18 is a diagram showing the production of interferon gamma when IL-12 and an antibody were added. "NoAb" represents a sample supplemented with only IL-12 without being supplemented with an antibody, and "NoIL-12" represents a sample supplemented with neither IL-12 nor an antibody.

These fusion proteins were tested to see whether they would be cleaved by protease. Human-derived urokinase (human uPA, huPA) (R&D Systems, 1310-SE-010) was used as the protease. Cleavage of the fusion proteins by the protease was evaluated by reducing SDS-PAGE. Reaction of 0.1 mg/ml of the fusion protein with 30 nM huPA was performed at 37° C. for one hour, and cleavage of the fusion protein was evaluated by reducing SDS-PAGE. As a result, whereas the protease treatment did not cleave G7H-G1T4/hCXCL10R75A.G4SGGGG.G7L-LT0, the protease treatment of G7H-G1T4/hCXCL10R75A.G7L.12aa0054-LT0, which had an inserted protease cleavage sequence, yielded new bands between 15 kDa and 25 kDa (FIG. 15), showing its cleavage by the protease treatment.

8-2. Evaluation of Migration Activity Associated with Protease Cleavage of an Anti-CXCL10 Neutralizing Antibody-CXCL10 Fusion Protein with an Introduced Protease Cleavage Sequence The anti-CXCL10 neutralizing antibody-CXCL10 fusion protein produced by fusion between the protease cleavage sequence-introduced anti-CXCL10 neutralizing antibody and CXCL10 was evaluated as to whether its protease cleavage would cause release of CXCL10 and thereby cell migration.

As a reference for comparison of the activity of hCXCL10R75A released from the fusion protein, hCXCL10R75A-His (SEQ ID NO: 373), which exhibits the activity of hCXCL10R75A only, was produced and purified by the following method: A histidine tag was added to the C-terminus of the human CXCL10 variant hCXCL10R75A (SEQ ID NO: 370), which was mutated to be protease-resistant, to produce a histidine-tagged human CXCL10 variant, hCXCL10R75A-His (SEQ ID NO: 373). hCXCL10R75A-His (SEQ ID NO: 373) was transiently expressed using Expi293™ (Life Technologies) according to a method known to those skilled in the art, and purified using Nickel-Sepharose according to a method known to those skilled in the art.

To evaluate cell migration activity, a Ba/F3 transfectant cell expressing mouse CXCR3 (mCXCR3) was produced (hereinafter, BaF3/mCXCR3), and this cell was used along with HTS Transwell™-96 Permeable Support with 5.0 μm Pore Polycarbonate Membrane (Cat. 3387, Corning).

Analytes for uPA (+) were prepared by adding recombinant huPA (Cat. 1310-SE, R&D systems) to 0.15 μg/mL of hCXCL10R75A-His, 1.5 μg/mL of the fusion protein G7H-GIT4/hCXCL10R75A.G4SGGGG.G7L-LT0 containing no protease cleavage sequence, or 1.5 μg/mL of the protease cleavage sequence-containing fusion protein G7H-GIT4/hCXCL10R75A.G7L. 12aa0054-LT0, at a final concentration of 30 nM in a 2.0 mL 96-well deep well plate (Cat. P-DW-20-C-S, Axygen). 1.5 μg/mL of G7H-G1T4/hCXCL10R75A.G4SGGGG.G7L-LT0 and G7H-GIT4/hCXCL10R75A.G7L.12aa0054-LT0 contain 0.15 μg/mL equivalent of hCXCL10R75A. For uPA (−) analytes, 0.15 μg/mL of hCXCL10R75A-His, 1.5 μg/mL of the fusion protein G7H-GIT4/hCXCL10R75A.G4SGGGG.G7L-LT0 containing no protease cleavage sequence, or 1.5 μg/mL of the protease cleavage sequence-containing fusion protein G7H-G1T4/hCXCL10R75A.G7L.12aa0054-LT0, was used.

235 μL of each solution to be analyzed was transferred to the lower chamber, and 75 μL/well of BaF3/mCXCR3 cells were seeded on the upper chamber so that each well contained $2.0\times10^5$ cells. They were allowed to react for six hours. The reaction was performed at 37° C., 5% $CO_2$. After six hours of reaction, 100 μL of the solution in the lower chamber was transferred to OptiPlate-96 (Cat. 6005299, PerkinElmer), and 100 μL of CellTiter-Glo™ Luminescent Cell Viability Assay solution (Cat. G7571, Promega) was added. This was allowed to react for 10 minutes, and then the luminescent value was measured with SpectraMax® M3 Multi-Mode Microplate Reader (Molecular Devices) to evaluate the degree of cell migration to the lower chamber. The results are shown in FIG. 16. Compared to addition of CXCL10R75A-His, addition of protease-untreated G7H-G1T4/hCXCL10R75A.G7L.12aa0054-LT0 fusion protein decreased the luminescence intensity. Since the luminescence intensity reflects the amount of cells that migrated, the biological activity of CXCL10R75A was found to be neutralized in G7H-GIT4/hCXCL10R75A.G7L.12aa0054-LT0. On the other hand, addition of protease-treated G7H-G1T4/hCXCL10R75A.G7L.12aa0054-LT0 resulted in a recovery in the luminescence intensity as compared to the addition of protease-untreated G7H-G1T4/hCXCL10R75A.G7L.12aa0054-LT0, showing that it allows cell migration comparable to CXCL10R75A-His. No luminescence intensity recovery was seen for G7H-G1T4/hCXCL10R75A.G4SGGGG.G7L-LT0, which had no cleavage sequence, after protease treatment. This result indicates that protease cleavage of G7H-GIT4/hCXCL10R75A.G7L.12aa0054-LT0 reduces the neutralization ability of the antibody portion of the fusion protein against CXCL10R75A.

Example 9 Preparation of Anti-IL-12 Neutralizing Antibody with Introduced Protease Cleavage Sequence and Flexible Linker Sequence, and Evaluation of IL-12 Activation Associated with Protease Cleavage 9-1. Preparation of Anti-IL-12 Neutralizing Antibody with Introduced Protease Cleavage Sequence and Flexible Linker Sequence IL-12 is a cytokine having an immunostimulatory effect. IL-12 activates immunocytes and thereby exerts an antitumor effect, while the systemic exposure of IL-12 has also been reported to cause severe adverse reactions (Nat Immunol. 2012 Jul. 19; 13 (8): 722-8).

UstkH-G1T4CYTM1inP1 (SEQ ID NO: 146), a heavy chain variant of ustekinumab (a neutralizing antibody against human IL-12) was designed by inserting a sequence containing peptide sequence A (SEQ ID NO: 3) which is reportedly cleavable by urokinase (uPA) and matriptase (MT-SP1), and a flexible linker consisting of a glycine-serine polymer, near the boundary between the variable and constant regions of the heavy chain (UstkH-GIT4, heavy chain: SEQ ID NO: 144) of an anti-IL12 antibody having the same variable region as that of ustekinumab. An expression vector encoding an ustekinumab variant UstkH-G1T4CYTM1inP1/UstkL-KT0 (heavy chain: SEQ ID NO: 146, light chain: SEQ ID NO: 145), which is a combination of UstkH-GIT4CYTM1inP1 and the light chain of ustekinumab (UstkL-KT0; SEQ ID NO: 145), was prepared according to a method known to those skilled in the art. This ustekinumab variant UstkH-GIT4CYTM1inP1/UstkL-kT0 was transiently expressed using FreeStyle™ 293 (Life Technologies Corp.) according to a method known to those skilled in the art, and purified using protein A according to a method known to those skilled in the art. The anti-IL12 antibody and its antibody variant of this Example contained the following CDR sequences: H-CDR1 (TYWLG; SEQ ID NO: 386), H-CDR2 (IMSPVDSDIRYSPSFQG; SEQ ID NO: 387), H-CDR3 (RRPGQGYFDF; SEQ ID NO: 388), L-CDR1 (RASQGISSWLA; SEQ ID NO: 389), L-CDR2 (AASSLQS; SEQ ID NO: 390), and L-CDR3 (QQYNIYPYT; SEQ ID NO: 391).

9-2. Protease Cleavage of Anti-IL-12 Neutralizing Antibody with Introduced Protease Cleavage Sequence and Flexible Linker Sequence Whether the antibody prepared in 9-1 would be cleaved by protease was verified. Human-derived recombinant Human Matriptase/ST14 Catalytic Domain (human MT-SP1, hMT-SP1) (R&D Systems, Inc., 3946-SE-010), mouse-derived recombinant Mouse Matriptase/ST14 Catalytic Domain (mouse MT-SP1, mMT-SP1) (R&D Systems, Inc., 4735-SE-010), and human-derived urokinase (human uPA, huPA) (R&D Systems, Inc., 1310-SE-010) were used as the protease. For protease treatment, hMT-SP1, mMT-SP1, or huPA was added at a final concentration of 10.1, 16.9, or 9.17 UM to ustekinumab (UstkH-G1T4/UstkL-KT0) or the ustekinumab variant UstkH-G1T4CYTM1inP1/UstkL-KT0, followed by overnight reaction at 37° C.

9-3. Confirmation of Cleavage of Cleaved Anti-IL-12 Neutralizing Antibody with Introduced Protease Cleavage Sequence and Flexible Linker Sequence, and Evaluation of IL-12 Activation The protease cleavage of the antibody was evaluated by reducing SDS-PAGE. As a result, UstkH-GIT4/UstkL-KT0 did not undergo cleavage by each protease, whereas each protease treatment of UstkH-GIT4CYTM1inP1/UstkL-KT0 with introduced protease cleavage sequence and flexible linker generated a new band between 25 kDa and 50 kDa (FIG. 17). Thus, the anti-IL-12 neutralizing antibody (UstkH-GIT4CYTM1inP1/UstkL-KT0) with introduced protease cleavage sequence and flexible linker sequence was confirmed to be cleaved by protease.

Next, whether IL-12 would be released from its complex with the antibody by the protease cleavage of the antibody to exert physiological activity, was evaluated. The physiological activity of IL-12 was evaluated on the basis of the IFN-γ (also referred to as interferon gamma or IFN-g) production of a human cell line NK92. The NK92 cells were inoculated at $1\times10^5$ cells/well to a 96-well cell culture plate. 10 ng/ml of IL-12 and the protease-treated antibody (UstkH-GIT4/UstkL-KT0 or UstkH-G1T4CYTM1inP1/UstkL-KT0; concentration of each antibody: 20, 4, 0.8, 0.16, 0.032, 0.0054, and 0.0013 μg/mL) were added thereto. 48 hours later, the amount of IFN-γ produced was measured by ELISA. In order to evaluate the influence of the antibody on IL-12 activity, an experiment was also conducted by the addition of only protease-treated IL-12 without the addition of an antibody (No Ab). FIG. 18 shows the results of measuring the concentration of interferon gamma. UstkH-G1T4/UstkL-KT0 (having no protease cleavage sequence) treated with each protease suppressed the production of interferon gamma by IL-12 (or neutralized), and 0.8 μg/mL of the antibody suppressed the interferon gamma production to the same level as in the absence of IL-12 (No IL-12). On the other hand, UstkH-G1T4CYTM1inP1/UstkL-kT0 (containing the protease cleavage sequence) treated with each protease resulted in interferon gamma production at all antibody concentrations, as compared with the addition of UstkH-G1T4/UstkL-kT0 having no protease cleavage sequence. From this result, UstkH-G1T4CYTM1inP1/

UstkL-KT0 was confirmed to allow IL-12 to act on cells, through the attenuation of its ability to neutralize IL-12 in association with protease cleavage.

Example 10 Evaluation of Antibody Produced by Introducing Various Protease Cleavage Sequences in Anti-Human CXCL10 Neutralizing Antibody 10-1. Introduction of Protease Cleavage Sequence to Anti-Human CXCL10 Neutralizing Antibody Expression vectors of CXCL10 neutralizing antibodies MabCXCL10 (heavy chain: EEIVH (SEQ ID NO: 1), light chain: EEIVL (SEQ ID NO: 2)) and MabCXCL10_G7 (heavy chain: G7H-G1T4 (SEQ ID NO: 368), light chain: G7L-LT0 (SEQ ID NO: 369)) were prepared according to a method known to those skilled in the art, and the antibodies were expressed using FreeStyle™ 293 cells (Invitrogen Corp.) or Expi293™ cells (Life Technologies Corp.) and purified according to methods known to those skilled in the art.

Each cleavage sequence shown in Table 2 was inserted near the boundary between the heavy chain variable region and constant region of MabCXCL10 or MabCXCL10_G7 to prepare a MabCXCL10 heavy chain variant. Sequences of MabCXCL10 heavy chain variant inserted with a protease cleavage sequence are shown in Table 3.

TABLE 2

Protease Cleavage Sequences

| SEQ ID NO | Cleavage sequence |
|---|---|
| 335 | TSGSGRSANARG |
| 336 | TSQSGRSANQRG |
| 337 | TSPSGRSAYPRG |
| 338 | TSGSGRSATPRG |
| 339 | TSQSGRSATPRG |
| 340 | TSASGRSATPRG |
| 341 | TSYSGRSAVPRG |
| 342 | TSYSGRSANFRG |
| 343 | TSSSGRSATPRG |
| 344 | TSTTGRSASPRG |
| 345 | TSTSGRSANPRG |

TABLE 3

MabCXCL10 Heavy Chain Variants and MabCXCL10_G7 Heavy Chain Variants

| SEQ ID NO | Heavy chain variant name |
|---|---|
| 346 | EIdHA12aa0004-G1T4 |
| 347 | EIdHA12aa0010-G1T4 |
| 348 | EIdHA12aa0016-G1T4 |
| 349 | EIdHA12aa0054-G1T4 |
| 350 | EIdHA12aa0063-G1T4 |
| 351 | EIdHA12aa0081-G1T4 |

TABLE 3-continued

MabCXCL10 Heavy Chain Variants and MabCXCL10_G7 Heavy Chain Variants

| SEQ ID NO | Heavy chain variant name |
|---|---|
| 352 | EIdHA12aa0089-G1T4 |
| 353 | EIdHA12aa0095-G1T4 |
| 354 | EIdHA12aa0103-G1T4 |
| 355 | EIdHA12aa0126-G1T4 |
| 356 | EIdHA0003-G1T4 |
| 357 | G7H.12aa0004-G1T4 |
| 358 | G7H.12aa0010-G1T4 |
| 359 | G7H.12aa0016-G1T4 |
| 360 | G7H.12aa0054-G1T4 |
| 361 | G7H.12aa0063-G1T4 |
| 362 | G7H.12aa0081-G1T4 |
| 363 | G7H.12aa0089-G1T4 |
| 364 | G7H.12aa0095-G1T4 |
| 365 | G7H.12aa0103-G1T4 |
| 366 | G7H.12aa0126-G1T4 |
| 367 | G7H.12aa-G1T4 |

MabCXCL10 variants and MabCXCL10_G7 variants shown in Table 4, prepared by combining a heavy chain variant of Table 3 with a light chain, were transiently expressed using FreeStyle™ 293 cells (Invitrogen Corp.) or Expi293™ cells (Life Technologies Corp.) according to a method known to those skilled in the art, and purified using protein A according to a method known to those skilled in the art.

TABLE 4

MabCXCL10 Variants and MabCXCL10_G7 Variants

| Antibody name | Heavy chain SEQ ID NO | Light chain SEQ ID NO |
|---|---|---|
| EIdHA12aa0004 | 346 | 2 |
| EIdHA12aa0010 | 347 | 2 |
| EIdHA12aa0016 | 348 | 2 |
| EIdHA12aa0054 | 349 | 2 |
| EIdHA12aa0063 | 350 | 2 |
| EIdHA12aa0081 | 351 | 2 |
| EIdHA12aa0089 | 352 | 2 |
| EIdHA12aa0095 | 353 | 2 |
| EIdHA12aa0103 | 354 | 2 |
| EIdHA12aa0126 | 355 | 2 |
| EIdHA0003 | 356 | 2 |
| G7H.12aa0004 | 357 | 369 |
| G7H.12aa0010 | 358 | 369 |
| G7H.12aa0016 | 359 | 369 |
| G7H.12aa0054 | 360 | 369 |
| G7H.12aa0063 | 361 | 369 |
| G7H.12aa0081 | 362 | 369 |
| G7H.12aa0089 | 363 | 369 |
| G7H.12aa0095 | 364 | 369 |
| G7H.12aa0103 | 365 | 369 |
| G7H.12aa0126 | 366 | 369 |
| G7H.12aa | 367 | 369 |

10-2. Evaluation of Protease Cleavage of Anti-Human CXCL10 Neutralizing Antibody with Multiple Protease Cleavage Sequences Introduced in its Heavy Chain Region Whether the antibodies prepared in 10-1 would be cleaved by protease was verified. Recombinant Human Matriptase/ST14 Catalytic Domain (human MT-SP1, hMT-SP1) (R&D Systems, Inc., 3946-SE-010) was used as the protease. 10 nM protease and 50 μg/mL of each antibody were reacted in PBS under a condition of 37° C. for 20 hours, followed by reducing SDS-PAGE. The results are shown in FIGS. 19A and 19B. The hMT-SP1 treatment of the MabCXCL10 variants and the MabCXCL10_G7 variants shown in Table 4 generated a new band around 37 kDa. Thus, the protease cleavage sequences shown in Table 2 were confirmed to be cleaved by hMT-SP1. Also, the protease cleavage sequences shown in Table 2 were confirmed to be cleaved by human uPA and mouse uPA by a similar method.

Example 11 Preparation and Evaluation of Polypeptides with Diverse Introduced Protease Cleavage Sequences 11-1. Preparation of Polypeptide with Introduced Recognition Sequence for Diverse Proteases An expression vector of MRA (heavy chain: MRAH-G1T4 (SEQ ID NO: 147), light chain: MRAL-k0 (SEQ ID NO: 148)), a neutralizing antibody against human IL-6R, was prepared according to a method known to those skilled in the art. MRA had the following CDR sequences: H-CDR1 (SDHAWS; SEQ ID NO: 398), H-CDR2 (YISYSGITTYNPSLKS; SEQ ID NO: 399), H-CDR3 (SLARTTAMDY; SEQ ID NO: 400), L-CDR1 (RASQDISSYLN; SEQ ID NO: 401), L-CDR2 (YTSRLHS; SEQ ID NO: 402), and L-CDR3 (QQGNTLPYT; SEQ ID NO: 403).

Table 5 shows peptide sequences known to be cleaved by MMP-2, MMP-7, or MMP-9, and peptide sequences containing a flexible linker consisting of a glycine-serine polymer in the vicinity of these sequences.

TABLE 5

| Protease | Inserted sequence | SEQ ID NO |
|---|---|---|
| MMP-2<br>MMP-9 | PLGLAG | 34 |

TABLE 5-continued

| Protease | Inserted sequence | SEQ ID NO |
|---|---|---|
| MMP-2 | GAGIPVSLRSGAG | 70 |
| MMP-2 | GPLGIAGQ | 71 |
| MMP-2 | GGPLGMLSQS | 72 |
| MMP-2 | PLGLWA | 73 |
| MMP-7 | VPLSLTMG | 35 |
| MMP-7 | GAGVPLSLTMGAG | 75 |
| MMP-9 | GAGVPLSLYSGAG | 76 |
| MMP-2 MMP-9 | GGGGSPLGLAGGGGGS | 149 |
| MMP-2 | GGGGSGPLGIAGQGGGGS | 150 |
| MMP-2 | GGGGSPLGLWAGGGGS | 151 |
| MMP-9 | GGGGSGAGVPLSLYSGAGGGGGS | 152 |

Heavy chain variants: MEIVHG4SMP2MP9G4S-MEIVHG4SMP2MP9G4SG1T4 (SEQ ID NO: 153), MEIVHG4SMP2.2G4S-MEIVHG4SMP2.2G4SGIT4 (SEQ ID NO: 154), MEIVHG4SMP2.4G4S-MEIVHG4SMP2.4G4SGIT4 (SEQ ID NO: 155), MEIVHG4SMP9G4S-MEIVHG4SMP9G4SGIT4 (SEQ ID NO: 156), MEIVHMP2.1-MEIVHMP2.1G1T4 (SEQ ID NO: 157), MEIVHMP2.3-MEIVHMP2.3G1T4 (SEQ ID NO: 158), and MEIVHMP7.2-MEIVHMP7.2G1T4 (heavy chain: SEQ ID NO: 159), in which these inserted sequences were inserted near the boundary between the heavy chain variable region and constant region of the MRA antibody, were designed. Expression vectors encoding these heavy chain variants were prepared according to a method known to those skilled in the art.

MRA variants shown in Table 6, prepared by combining the above heavy chain variant with a MRA light chain, were transiently expressed using FreeStyle™ 293 cells (Invitrogen Corp.) or Expi293™ cells (Life Technologies Corp.) according to a method known to those skilled in the art, and purified using protein A according to a method known to those skilled in the art.

TABLE 6

| | MRA Variants | | |
|---|---|---|---|
| Protease | Antibody name | Heavy chain SEQ ID NO | Light chain SEQ ID NO |
| MMP-2 | MEIVHG4SMP2MP9G4S-MEICHG4SMP2MP9G4SG1T4/MRAL-k0 | 153 | 148 |
| MMP-2 | MEIVHG4SMP2.2G4S-MEICHG4SMP2.2G4SG1T4/MRAL-K0 | 154 | 148 |
| MMP-2 | MEIVHG4SMP2.4G4S-MEICHG4SMP2.4G4SG1T4/MRAL-k0 | 155 | 148 |
| MMP-9 | MEIVHG4SMP2MP9G4S-MEICHG4SMP2MP9G4SG1T4/MRAL-k0 | 153 | 148 |
| MMP-9 | MEIVHG4SMP9G4S-MEICHG4SMP9G4SG1T4/MRAL-k0 | 156 | 148 |
| MMP-2 | MEIVHMP2.1-MEIVHMP2.1G1T4/MRAL-k0 | 157 | 148 |
| MMP-2 | MEIVHMP2.3-MEIVHMP2.3G1T4/MRAL-k0 | 158 | 148 |
| MMP-7 | MEIVHMP7.2-MEIVHMP7.2G1T4/MRAL-k0 | 159 | 148 |

Figure 20A:
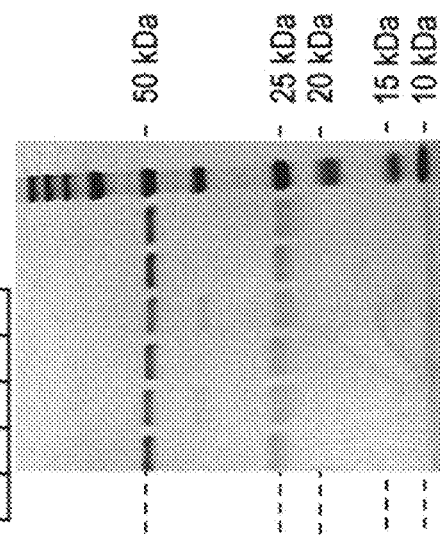
FIG. 20A is a diagram showing results of cleavage by various proteases.
Figure 20B:
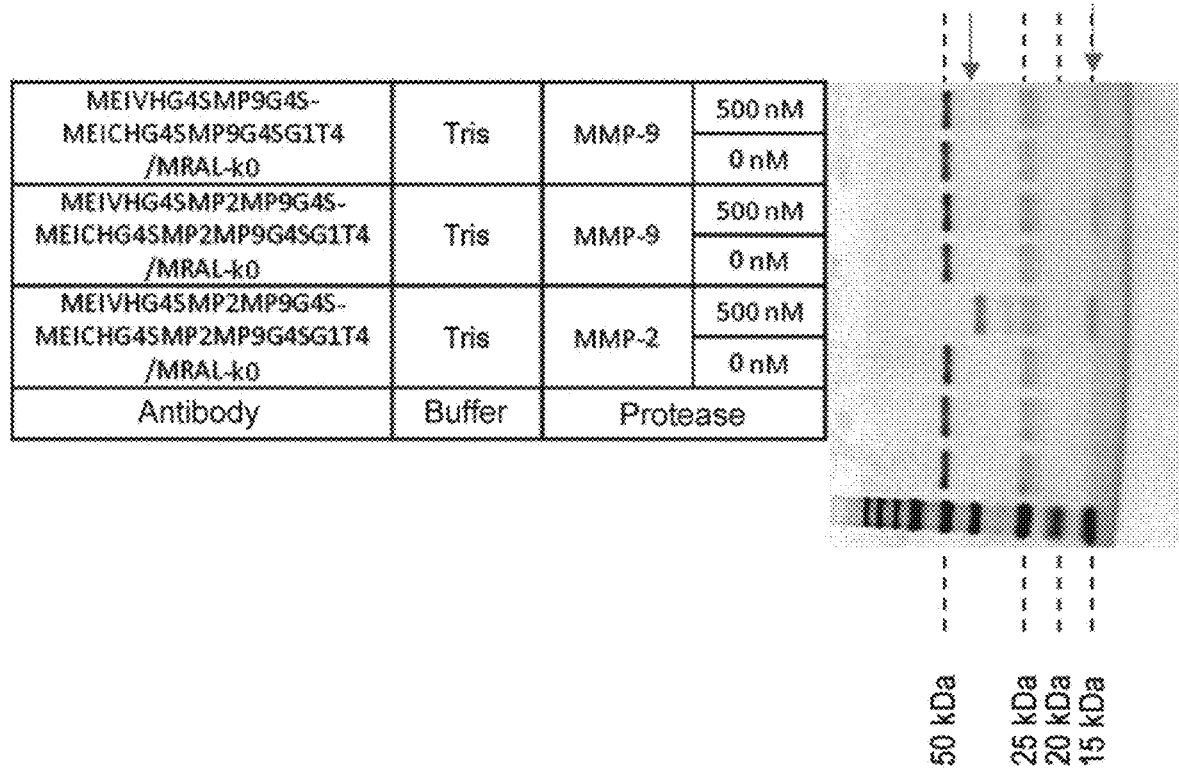
FIG. 20B is a diagram showing results of cleavage by various proteases.
Figure 21:
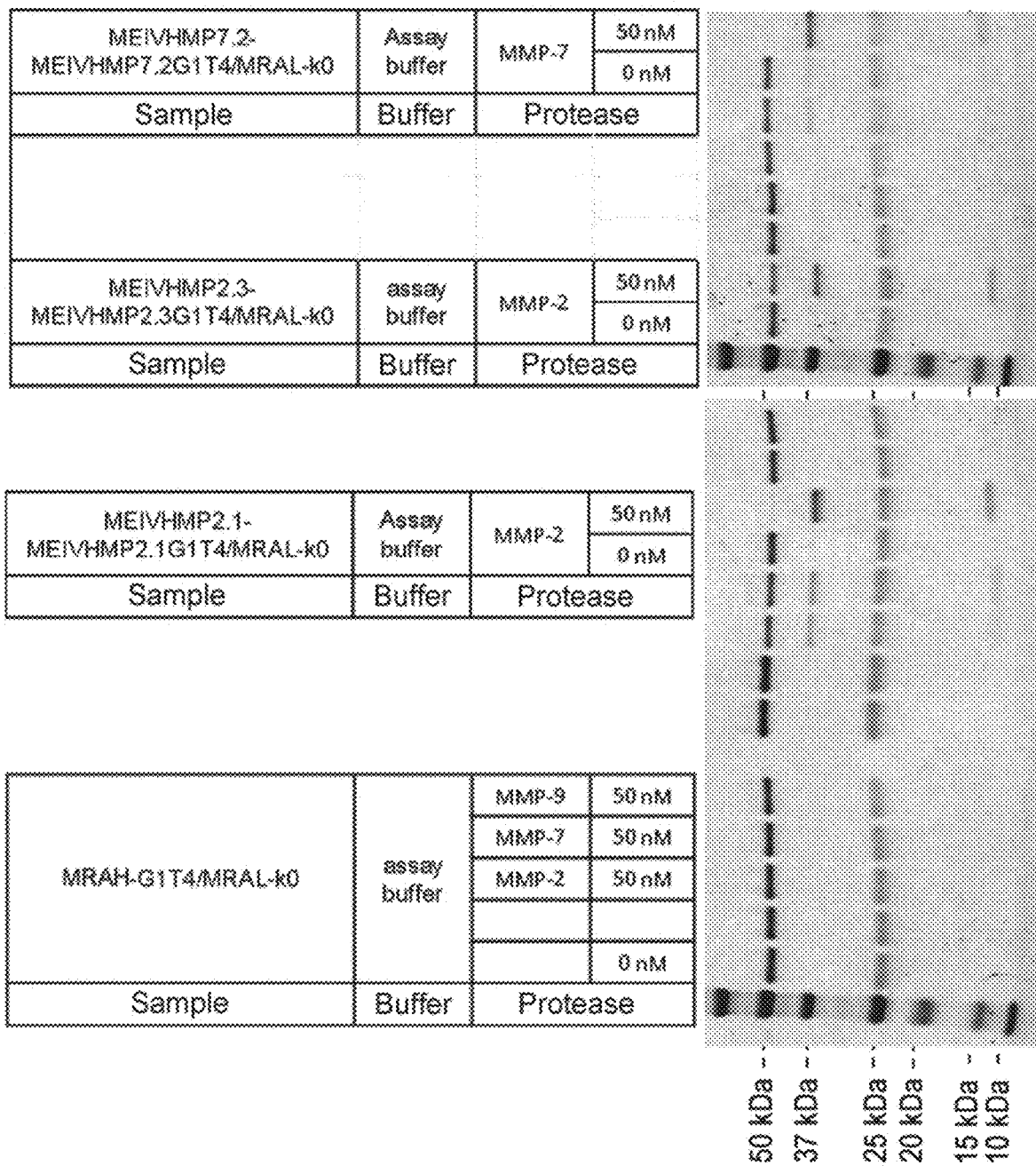
FIG. 21 is a diagram showing results of cleavage by various proteases.
Figure 22A:
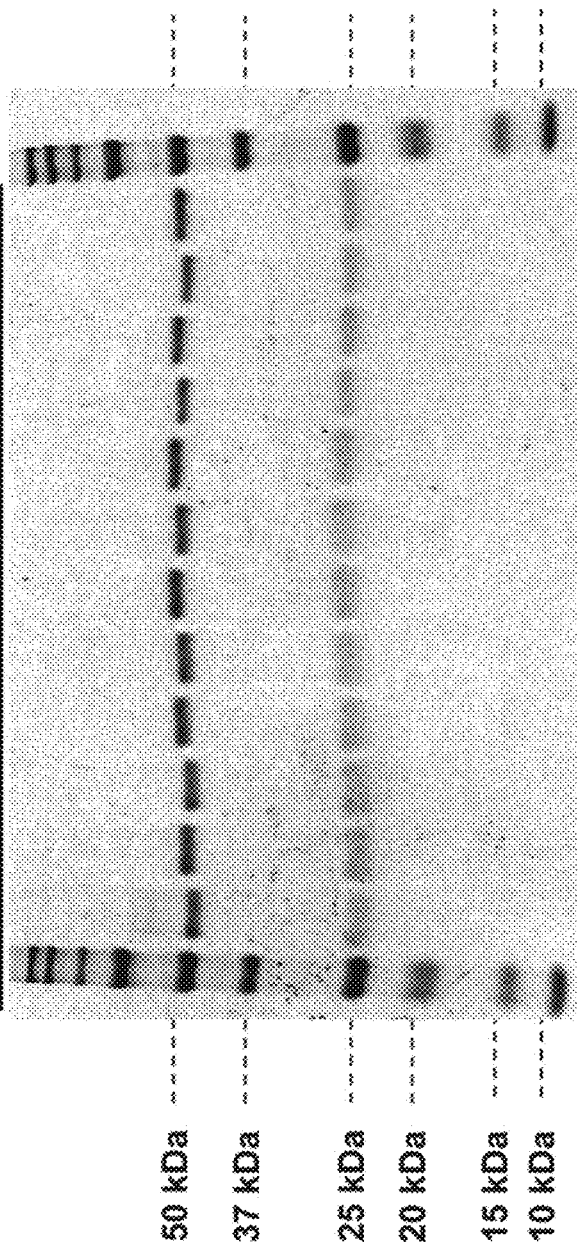
FIG. 22A is a diagram showing results of cleaving MRA antibody variants by protease.
Figure 22B:
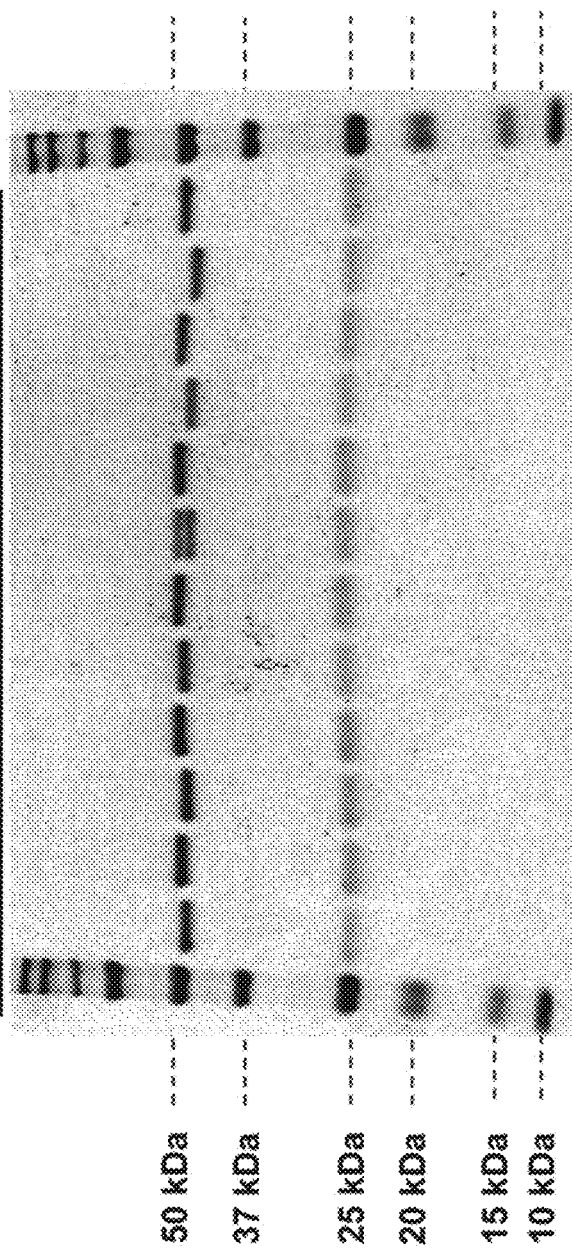
FIG. 22B is a diagram showing results of cleaving MRA antibody variants by protease.
Figure 22C:
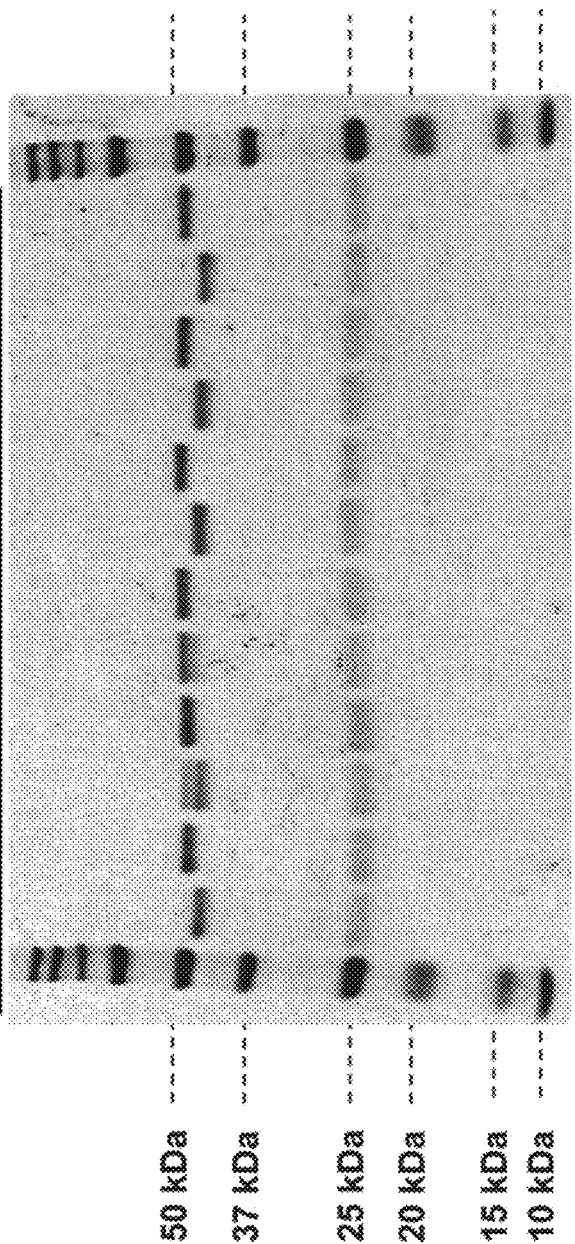
Figure 22D:
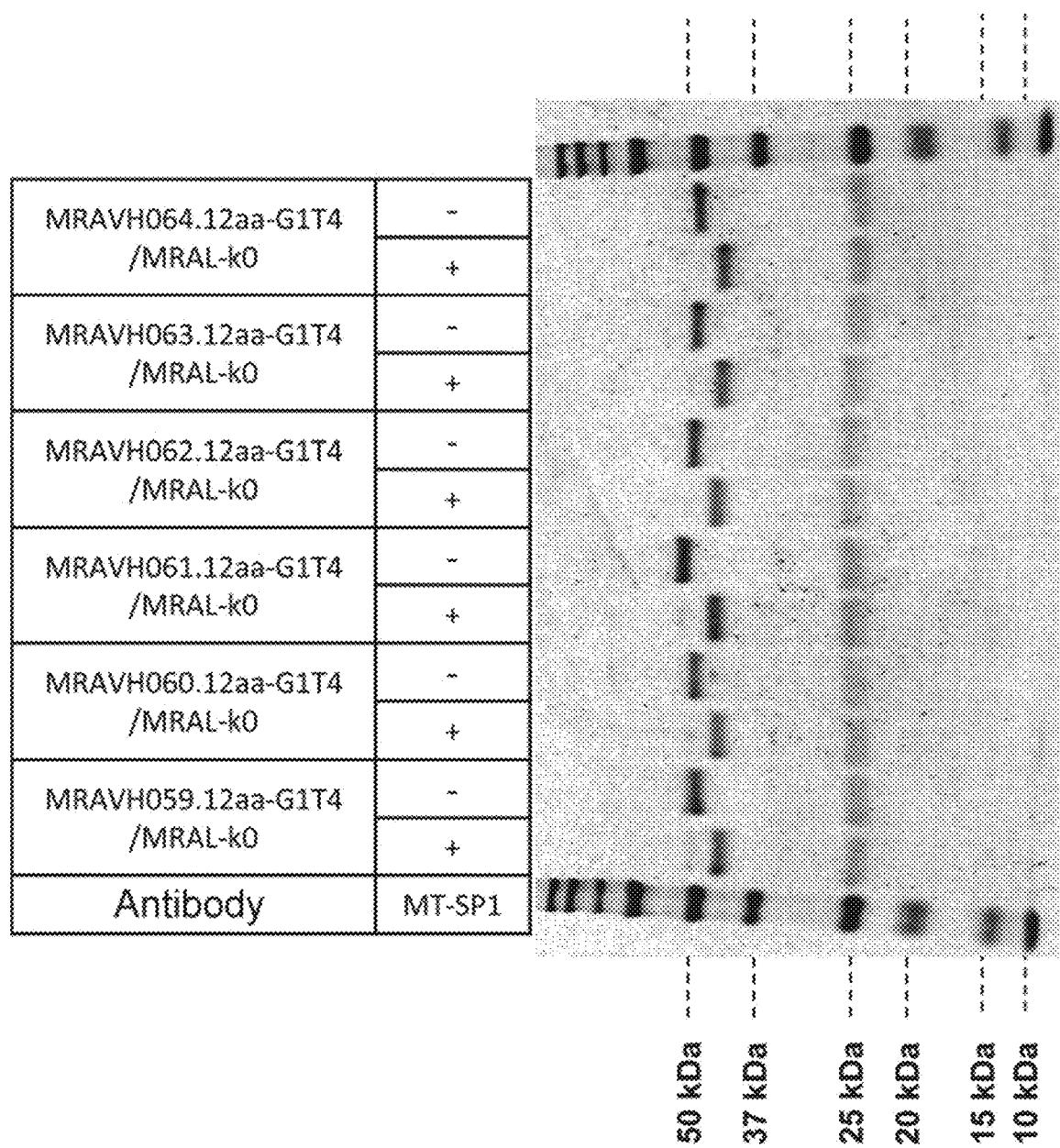
Figure 22E:
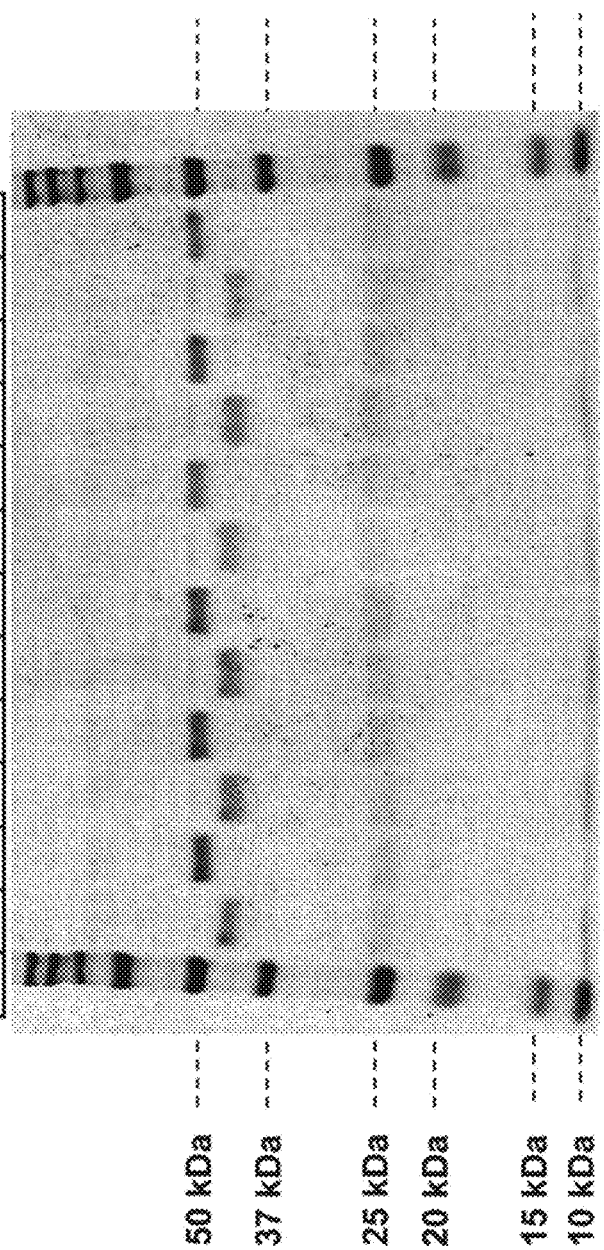
Figure 22F:
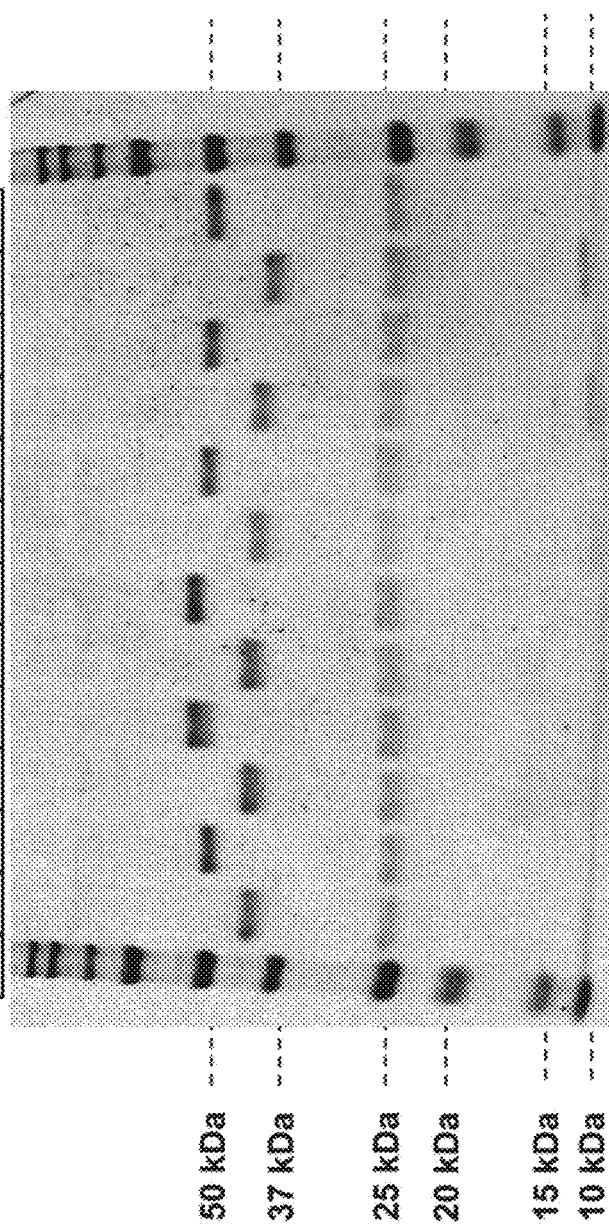
Figure 22G:
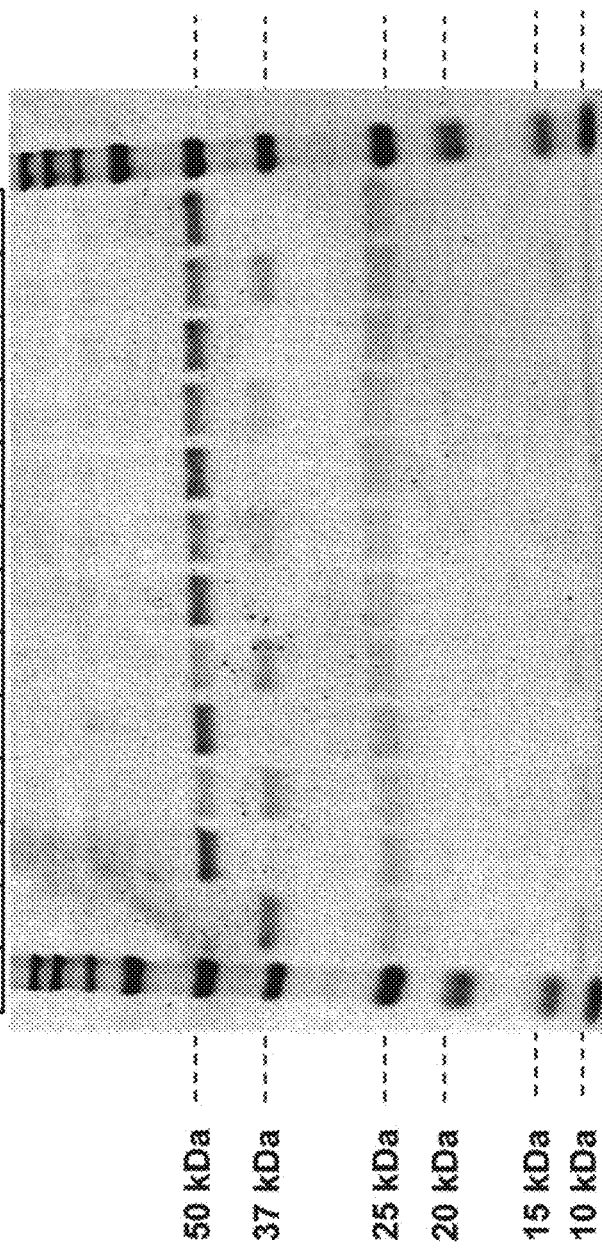
Figure 22H:
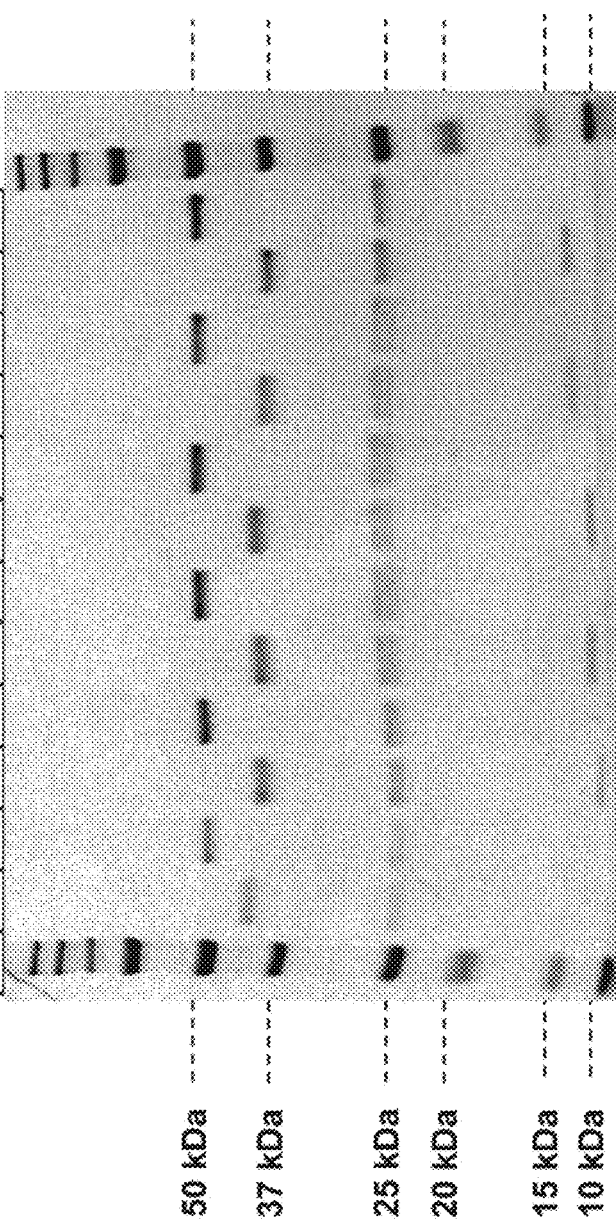
Figure 22I:
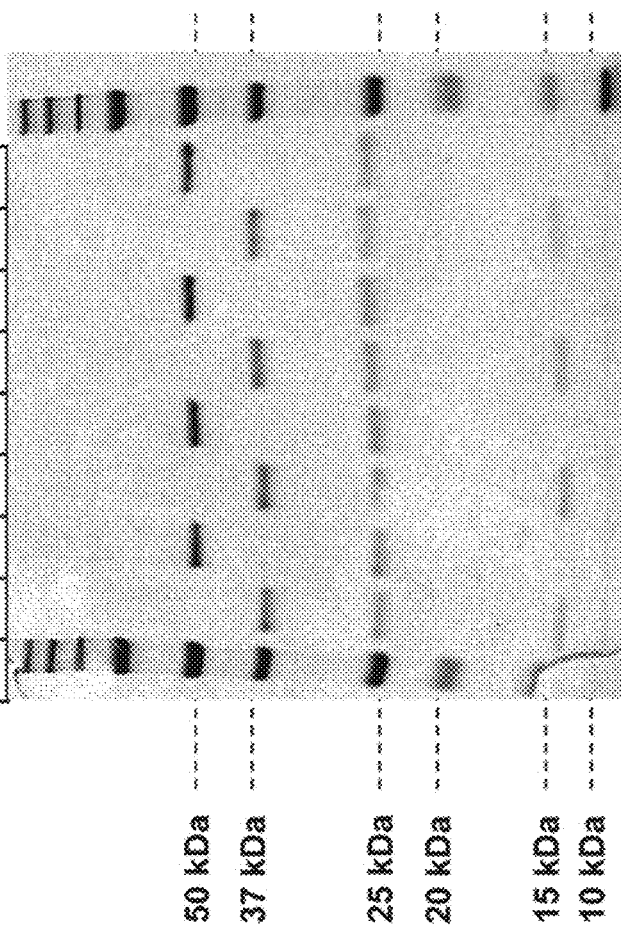
Figure 23A:
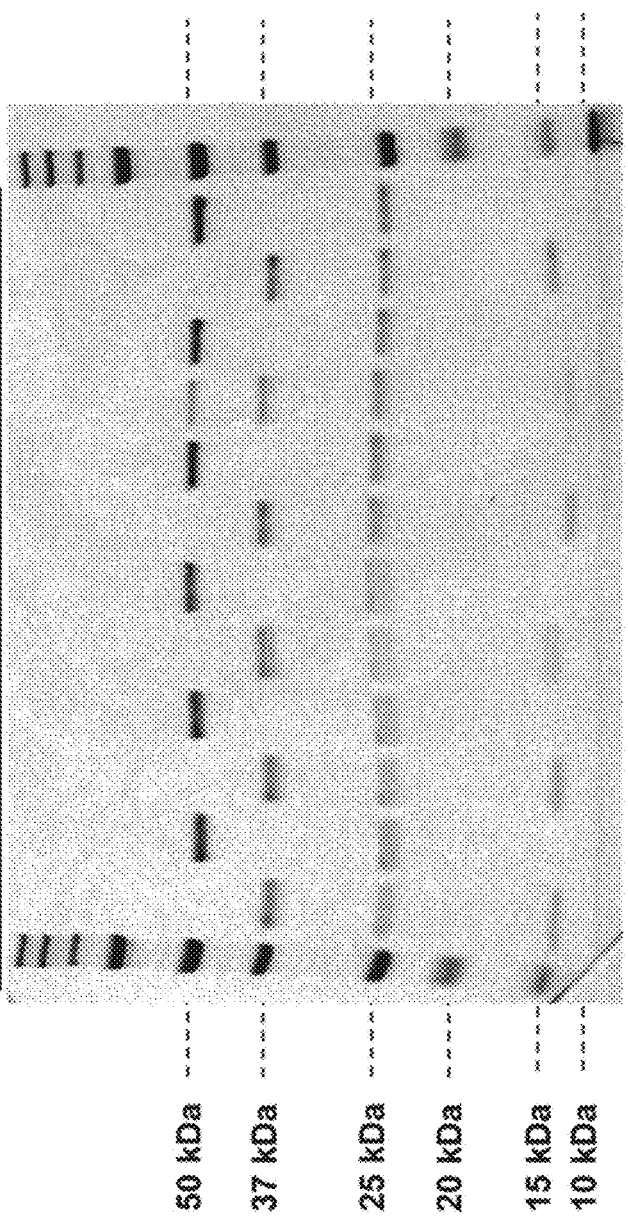
Figure 23B:
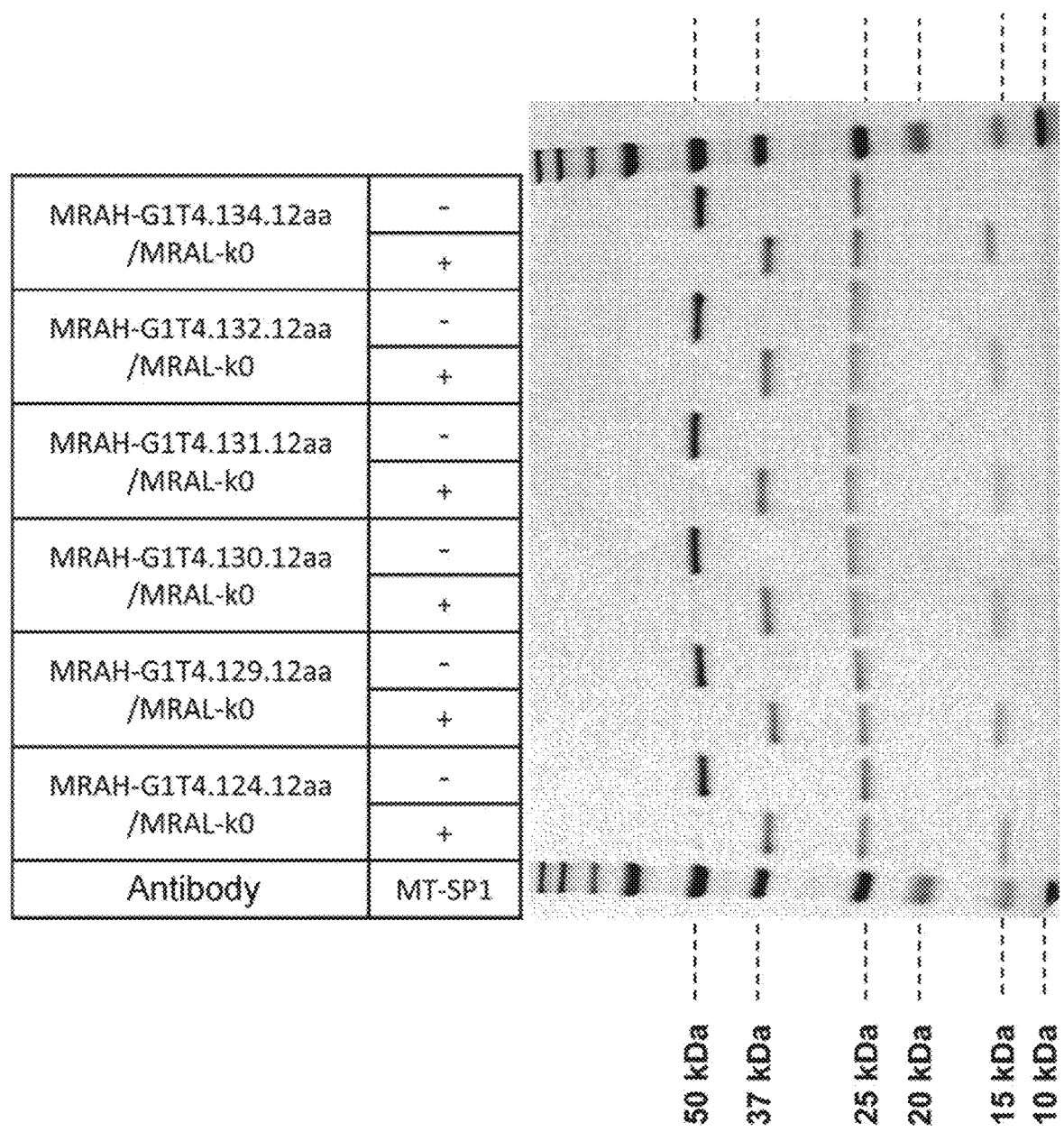
Figure 23C:
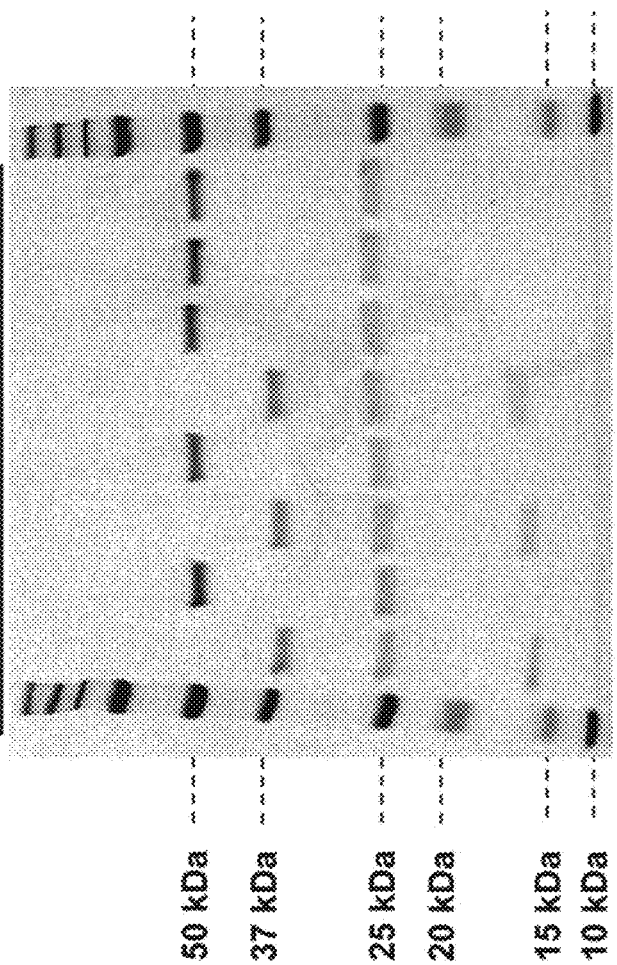
Figure 24A:
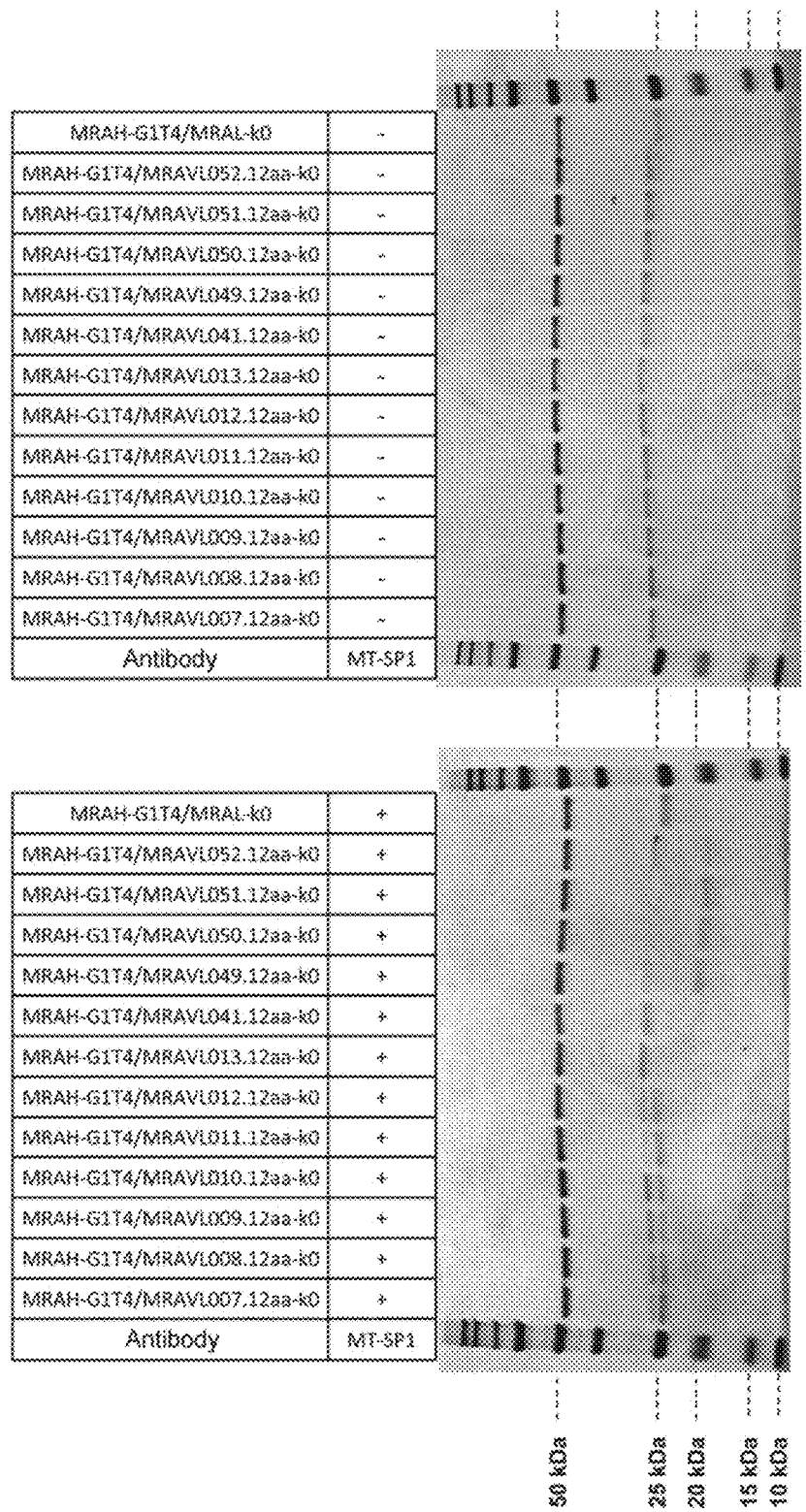
Figure 24B:
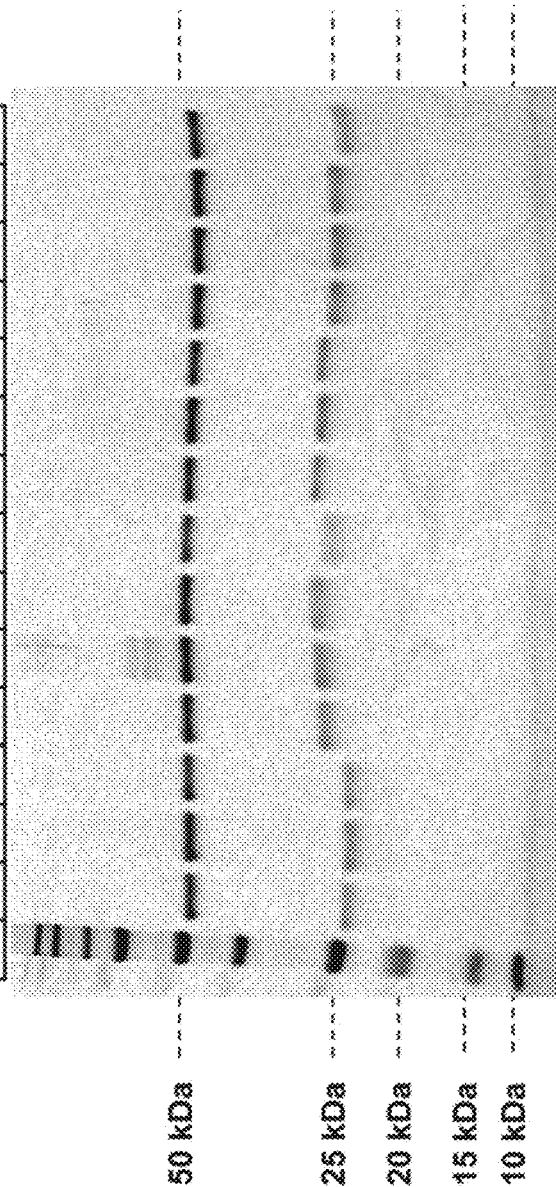
Figure 24D:
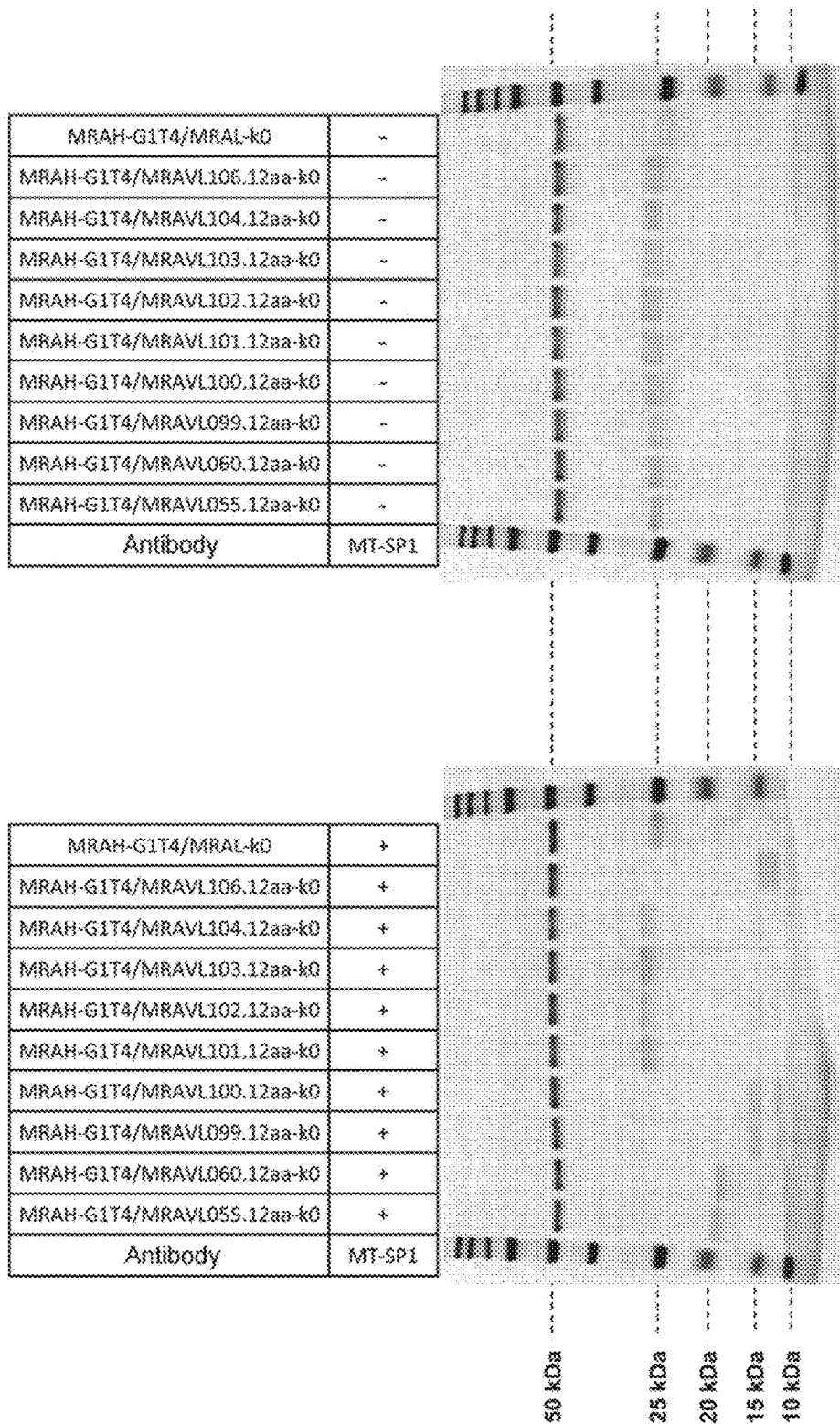
Figure 24E:
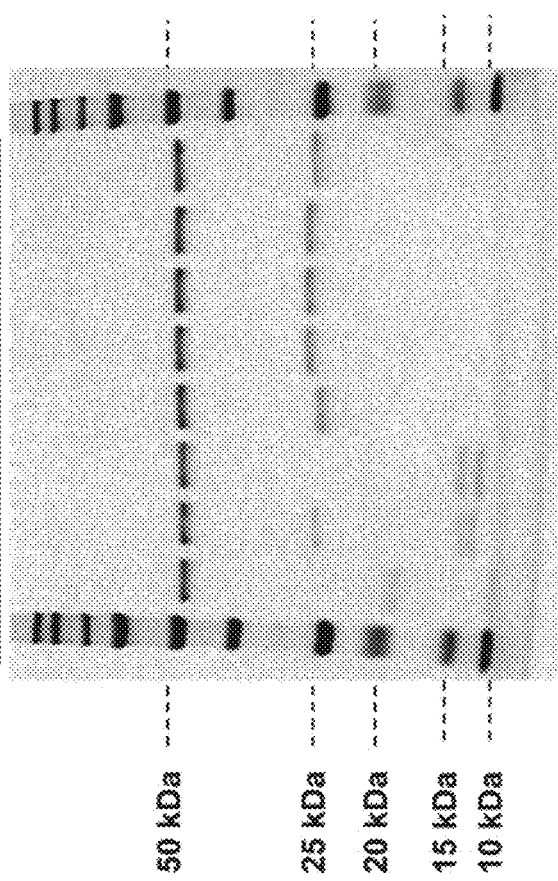
Figure 25A:
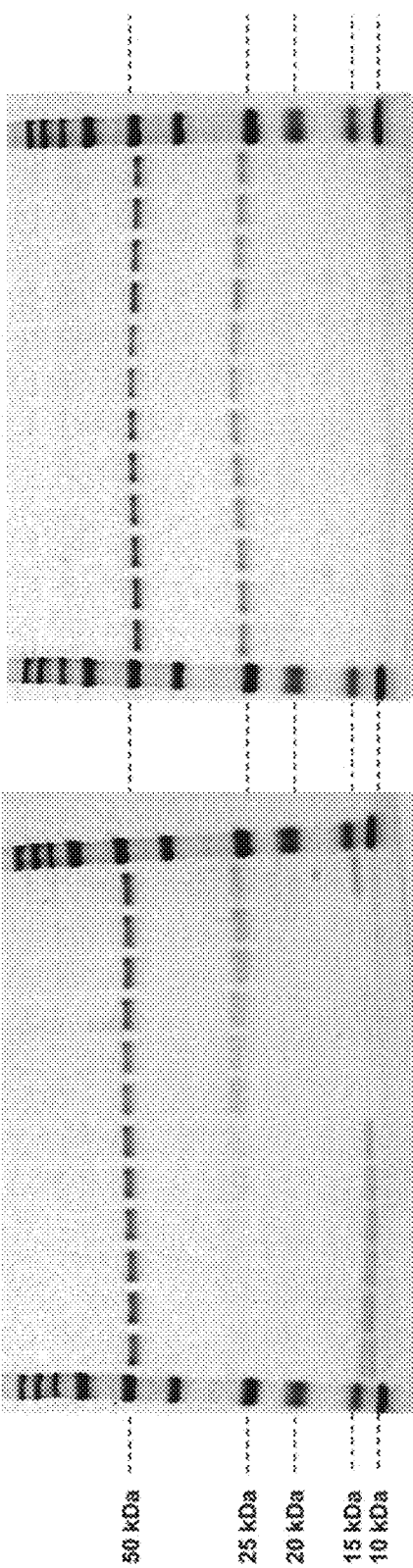
Figure 25B:
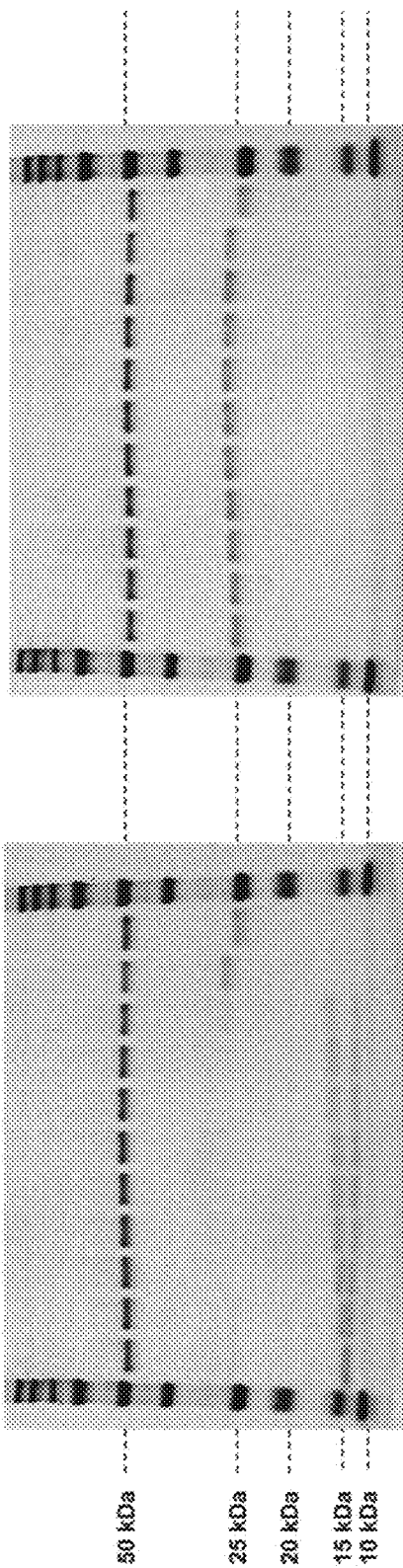

11-2. Evaluation of Protease Cleavage of Polypeptides with Introduced Recognition Sequences for Diverse Proteases Whether the MRA variants prepared in 11-1 would be cleaved by protease was verified. Recombinant human MMP-2 (R&D Systems, Inc., 902-MP-010), recombinant human MMP-7 (R&D Systems, Inc., 907-MP-010), or recombinant human MMP-9 (R&D Systems, Inc., 911-MP-010) was used as the protease. Each protease was used after being mixed with 1 mM p-aminophenylmercuric acetate (APMA; Abcam PLC, ab112146) and activated at 37° C. for 1 or 24 hours. 50 nM, 100 nM, or 500 nM protease and 50 µg/mL of each antibody were reacted in an assay buffer (MMP Activity Assay Kit (Fluorometric-Green) (ab112146), Component C: Assay Buffer) or 20 mM Tris-HCl, 150 mM NaCl, and 5 mM $CaCl_2$) (pH 7.2) (hereinafter, referred to as Tris) under a condition of 37° C. for 20 hours. Then, cleavage by the protease was evaluated by reducing SDS-PAGE. The results are shown in FIGS. 20A, 20B, and 21. The MRA antibody variants were each reacted with the protease shown in Table 6. The cleavage by MMP-2 was observed in MEIVHG4SMP2MP9G4S-MEIVHG4SMP2MP9G4SG1T4/MRAL-k0, MEIVHG4SMP2.2G4S-MEIVHG4SMP2.2G4SG1T4/MRAL-k0, MEIVHG4SMP2.4G4S-MEIVHG4SMP2.4G4SGIT4/MRAL-k0, MEIVHMP2.1-MEIVHMP2.1G1T4/MRAL-k0, and MEIVHMP2.3-MEIVHMP2.3G1T4/MRAL-k0. The cleavage by MMP-7 was observed in MEIVHMP7.2-MEIVHMP7.2G1T4/MRAL-k0. The cleavage by MMP-9 was observed in MEIVHG4SMP2MP9G4S-MEIVHG4SMP2MP9G4SGIT4/MRAL-k0 and MEIVHG4SMP9G4S-MEIVHG4SMP9G4SGIT4/MRAL-k0.

Example 12 Evaluation of Antibodies with Protease Cleavage Sequence Introduced at Diverse Positions of Heavy Chain 12-1. Preparation of Antibodies with a Protease Cleavage Sequence Introduced at Diverse Positions of Heavy Chain Peptide sequence B (SEQ ID NO: 160) reportedly cleavable by urokinase (uPA) and matriptase (MT-SP1) was inserted at each of different positions within an MRA heavy chain variable region (MRAH; SEQ ID NO: 161) to prepare MRA heavy chain variable region variants shown in Table 7. These MRA heavy chain variable region variants were each linked to an MRA heavy chain constant region (GIT4; SEQ ID NO: 162) to prepare MRA heavy chain variants. Expression vectors encoding the corresponding genes were prepared by a method known to those skilled in the art. Also, peptide sequence B (SEQ ID NO: 160) was inserted at each of different positions within an MRA heavy chain constant region (GIT4; SEQ ID NO: 162) to prepare MRA heavy chain constant region variants shown in Table 8. These MRA heavy chain constant region variants were each linked to an MRA heavy chain variable region (MRAH; SEQ ID NO: 161) to prepare MRA heavy chain variants. Expression vectors encoding the corresponding genes were prepared by a method known to those skilled in the art. Tables 7 and 8 also show the protease cleavage sequence insertion positions in the prepared MRA heavy chain variable region variants and MRA heavy chain constant region variants. The insertion positions in Table 7 were located at the constant region side next to the described position (Kabat numbering) in the antibody heavy chain variable region. The insertion positions in Table 8 were located at the variable region side next to the described position (EU numbering) in the antibody heavy chain constant region.

TABLE 7

MRA Heavy Chain Variable Region Variants and Protease Cleavage Sequence Insertion Positions

| MRA heavy chain variable region variant | Protease cleavage sequence insertion position (Kabat numbering) | SEQ ID NO |
|---|---|---|
| MRAVH007.12aa | 7 | 163 |
| MRAVH008.12aa | 8 | 164 |
| MRAVH009.12aa | 9 | 165 |
| MRAVH010.12aa | 10 | 166 |
| MRAVH011.12aa | 11 | 167 |
| MRAVH012.12aa | 12 | 168 |
| MRAVH013.12aa | 13 | 169 |
| MRAVH014.12aa | 14 | 170 |
| MRAVH015.12aa | 15 | 171 |
| MRAVH041.12aa | 40 | 172 |
| MRAVH042.12aa | 41 | 173 |
| MRAVH043.12aa | 42 | 174 |
| MRAVH044.12aa | 43 | 175 |
| MRAVH045.12aa | 44 | 176 |
| MRAVH046.12aa | 45 | 177 |
| MRAVH056.12aa | 55 | 178 |
| MRAVH057.12aa | 56 | 179 |
| MRAVH058.12aa | 57 | 180 |
| MRAVH059.12aa | 58 | 181 |
| MRAVH060.12aa | 59 | 182 |
| MRAVH061.12aa | 60 | 183 |
| MRAVH062.12aa | 61 | 184 |

TABLE 7-continued

MRA Heavy Chain Variable Region Variants and Protease Cleavage Sequence Insertion Positions

| MRA heavy chain variable region variant | Protease cleavage sequence insertion position (Kabat numbering) | SEQ ID NO |
|---|---|---|
| MRAVH063.12aa | 62 | 185 |
| MRAVH064.12aa | 63 | 186 |
| MRAVH065.12aa | 64 | 187 |
| MRAVH066.12aa | 65 | 188 |
| MRAVH067.12aa | 66 | 189 |
| MRAVH068.12aa | 67 | 190 |
| MRAVH069.12aa | 68 | 191 |
| MRAVH074.12aa | 73 | 192 |
| MRAVH075.12aa | 74 | 193 |
| MRAVH076.12aa | 75 | 194 |
| MRAVH077.12aa | 76 | 195 |
| MRAVH078.12aa | 77 | 196 |
| MRAVH087.12aa | 83 | 197 |
| MRAVH088.12aa | 84 | 198 |
| MRAVH089.12aa | 85 | 199 |
| MRAVH099.12aa | 95 | 200 |
| MRAVH100.12aa | 96 | 201 |
| MRAVH101.12aa | 97 | 202 |
| MRAVH102.12aa | 98 | 203 |
| MRAVH109.12aa | 103 | 204 |
| MRAVH110.12aa | 104 | 205 |
| MRAVH111.12aa | 105 | 206 |
| MRAVH112.12aa | 106 | 207 |
| MRAVH113.12aa | 107 | 208 |
| MRAVH114.12aa | 108 | 209 |
| MRAVH115.12aa | 109 | 210 |
| MRAVH116.12aa | 110 | 211 |
| MRAVH117.12aa | 111 | 212 |
| MRAVH118.12aa | 112 | 213 |
| MRAVH119.12aa | 113 | 214 |

TABLE 8

MRA Heavy Chain Constant Region Variants and Protease Cleavage Sequence Insertion Positions

| MRA heavy chain constant region variant | Protease cleavage sequence insertion position (EU numbering) | SEQ ID NO |
|---|---|---|
| G1T4.118.12aa | 119 | 215 |
| G1T4.119.12aa | 120 | 216 |
| G1T4.120.12aa | 121 | 217 |
| G1T4.121.12aa | 122 | 218 |
| G1T4.122.12aa | 123 | 219 |
| G1T4.123.12aa | 124 | 220 |
| G1T4.124.12aa | 125 | 221 |
| G1T4.129.12aa | 130 | 222 |
| G1T4.130.12aa | 131 | 223 |
| G1T4.131.12aa | 132 | 224 |
| G1T4.132.12aa | 133 | 225 |
| G1T4.134.12aa | 135 | 226 |
| G1T4.135.12aa | 136 | 227 |
| G1T4.137.12aa | 138 | 228 |
| G1T4.139.12aa | 140 | 229 |

MRA variants shown in Table 9, prepared by combining the above-prepared MRA heavy chain variant and the MRA light chain, were transiently expressed using FreeStyle™ 293 cells (Invitrogen Corp.) or Expi293™ cells (Life Technologies Corp.) according to a method known to those skilled in the art, and purified using protein A according to a method known to those skilled in the art.®

TABLE 9

MRA Variants

| Antibody name | Heavy chain SEQ ID NO | Light chain SEQ ID NO |
|---|---|---|
| MRAVH007.12aa-G1T4/MRAL-k0 | 404 | 148 |
| MRAVH008.12aa-G1T4/MRAL-k0 | 405 | 148 |
| MRAVH009.12aa-G1T4/MRAL-k0 | 406 | 148 |
| MRAVH010.12aa-G1T4/MRAL-k0 | 407 | 148 |
| MRAVH011.12aa-G1T4/MRAL-k0 | 408 | 148 |
| MRAVH012.12aa-G1T4/MRAL-k0 | 409 | 148 |
| MRAVH013.12aa-G1T4/MRAL-k0 | 410 | 148 |
| MRAVH014.12aa-G1T4/MRAL-k0 | 411 | 148 |
| MRAVH015.12aa-G1T4/MRAL-k0 | 412 | 148 |
| MRAVH041.12aa-G1T4/MRAL-k0 | 413 | 148 |
| MRAVH042.12aa-G1T4/MRAL-k0 | 414 | 148 |
| MRAVH043.12aa-G1T4/MRAL-k0 | 415 | 148 |

TABLE 9-continued

MRA Variants

| Antibody name | Heavy chain SEQ ID NO | Light chain SEQ ID NO |
|---|---|---|
| MRAVH044.12aa-G1T4/MRAL-k0 | 416 | 148 |
| MRAVH045.12aa-G1T4/MRAL-k0 | 417 | 148 |
| MRAVH046.12aa-G1T4/MRAL-k0 | 418 | 148 |
| MRAVH056.12aa-G1T4/MRAL-k0 | 419 | 148 |
| MRAVH057.12aa-G1T4/MRAL-k0 | 420 | 148 |
| MRAVH058.12aa-G1T4/MRAL-k0 | 421 | 148 |
| MRAVH059.12aa-G1T4/MRAL-k0 | 422 | 148 |
| MRAVH060.12aa-G1T4/MRAL-k0 | 423 | 148 |
| MRAVH061.12aa-G1T4/MRAL-k0 | 424 | 148 |
| MRAVH062.12aa-G1T4/MRAL-k0 | 425 | 148 |
| MRAVH063.12aa-G1T4/MRAL-k0 | 426 | 148 |
| MRAVH064.12aa-G1T4/MRAL-k0 | 427 | 148 |
| MRAVH065.12aa-G1T4/MRAL-k0 | 428 | 148 |
| MRAVH066.12aa-G1T4/MRAL-k0 | 429 | 148 |
| MRAVH067.12aa-G1T4/MRAL-k0 | 430 | 148 |
| MRAVH068.12aa-G1T4/MRAL-k0 | 431 | 148 |
| MRAVH069.12aa-G1T4/MRAL-k0 | 432 | 148 |
| MRAVH074.12aa-G1T4/MRAL-k0 | 433 | 148 |
| MRAVH075.12aa-G1T4/MRAL-k0 | 434 | 148 |
| MRAVH076.12aa-G1T4/MRAL-k0 | 435 | 148 |
| MRAVH077.12aa-G1T4/MRAL-k0 | 436 | 148 |
| MRAVH078.12aa-G1T4/MRAL-k0 | 437 | 148 |
| MRAVH087.12aa-G1T4/MRAL-k0 | 438 | 148 |
| MRAVH088.12aa-G1T4/MRAL-k0 | 439 | 148 |
| MRAVH089.12aa-G1T4/MRAL-k0 | 440 | 148 |
| MRAVH099.12aa-G1T4/MRAL-k0 | 441 | 148 |
| MRAVH100.12aa-G1T4/MRAL-k0 | 442 | 148 |
| MRAVH101.12aa-G1T4/MRAL-k0 | 443 | 148 |
| MRAVH102.12aa-G1T4/MRAL-k0 | 444 | 148 |
| MRAVH109.12aa-G1T4/MRAL-k0 | 445 | 148 |
| MRAVH110.12aa-G1T4/MRAL-k0 | 446 | 148 |
| MRAVH111.12aa-G1T4/MRAL-k0 | 447 | 148 |
| MRAVH112.12aa-G1T4/MRAL-k0 | 448 | 148 |
| MRAVH113.12aa-G1T4/MRAL-k0 | 449 | 148 |
| MRAVH114.12aa-G1T4/MRAL-k0 | 450 | 148 |
| MRAVH115.12aa-G1T4/MRAL-k0 | 451 | 148 |
| MRAVH116.12aa-G1T4/MRAL-k0 | 452 | 148 |
| MRAVH117.12aa-G1T4/MRAL-k0 | 453 | 148 |

TABLE 9-continued

MRA Variants

| Antibody name | Heavy chain SEQ ID NO | Light chain SEQ ID NO |
|---|---|---|
| MRAVH118.12aa-G1T4/MRAL-k0 | 454 | 148 |
| MRAVH119.12aa-G1T4/MRAL-k0 | 455 | 148 |
| MRAH-G1T4.118.12aa/MRAL-k0 | 456 | 148 |
| MRAH-G1T4.119.12aa/MRAL-k0 | 457 | 148 |
| MRAH-G1T4.120.12aa/MRAL-k0 | 458 | 148 |
| MRAH-G1T4.121.12aa/MRAL-k0 | 459 | 148 |
| MRAH-G1T4.122.12aa/MRAL-k0 | 460 | 148 |
| MRAH-G1T4.123.12aa/MRAL-k0 | 461 | 148 |
| MRAH-G1T4.124.12aa/MRAL-k0 | 462 | 148 |
| MRAH-G1T4.129.12aa/MRAL-k0 | 463 | 148 |
| MRAH-G1T4.130.12aa/MRAL-k0 | 464 | 148 |
| MRAH-G1T4.131.12aa/MRAL-k0 | 465 | 148 |
| MRAH-G1T4.132.12aa/MRAL-k0 | 466 | 148 |
| MRAH-G1T4.134.12aa/MRAL-k0 | 467 | 148 |
| MRAH-G1T4.135.12aa/MRAL-k0 | 468 | 148 |
| MRAH-G1T4.137.12aa/MRAL-k0 | 469 | 148 |
| MRAH-G1T4.139.12aa/MRAL-k0 | 470 | 148 |

12-2. Evaluation of Protease Cleavage of Anti-Human IL-6R Neutralizing Antibody with Protease Cleavage Sequence Introduced in its Antibody Heavy Chain Whether the MRA variants prepared in 12-1 would be cleaved by protease was verified. Recombinant Human Matriptase/ST14 Catalytic Domain (human MT-SP1, hMT-SP1) (R&D Systems, Inc., 3946-SE-010) was used as the protease. 10 nM protease and 50 μg/mL of each antibody were reacted in PBS under a condition of 37° C. for 20 hours, followed by reducing SDS-PAGE. The results are shown in FIGS. 22A, 22B, 22C, 22D, 22E, 22F, 22G, 22H, 22I, 23A, 23B, and 23C. The protease-treated MRA variants were cleaved at their heavy chains and generated a heavy chain band at a position with a smaller molecular weight than that of the heavy chains of protease-untreated MRA variants (a band appearing around 50 kDa in the MT-SP1 (−) lane in the drawings). From this result, the MRA variants prepared in 12-1 were confirmed to be cleaved by hMT-SP1.

Example 13 Evaluation of Antibodies with Protease Cleavage Sequence Introduced at Diverse Positions of Light Chain 13-1. Preparation of Antibodies with Protease Cleavage Sequence Introduced at Diverse Positions of Light Chain Peptide sequence B (SEQ ID NO: 160) reportedly cleavable by urokinase (uPA) and matriptase (MT-SP1) was inserted at each of different positions within an MRA light chain variable region (MRAL; SEQ ID NO: 230) to prepare MRA light chain variable region variants shown in Table 10. These MRA light chain variable region variants were each linked to an MRA light chain constant region (k0; SEQ ID NO: 231) to prepare MRA light chain variants. Expression vectors encoding the corresponding genes were prepared by a method known to those skilled in the art. Also, peptide sequence B (SEQ ID NO: 160) was inserted at each of different positions within an MRA light chain constant region (k0; SEQ ID NO: 231) to prepare MRA light chain constant region variants shown in Table 11. These MRA light chain constant region variants were each linked to an MRA light chain variable region (MRAL; SEQ ID NO: 230) to prepare MRA light chain variants. Expression vectors encoding the corresponding genes were prepared by a method known to those skilled in the art. Tables 10 and 11 also show the protease cleavage sequence insertion positions in the prepared MRA light chain variable region variants and MRA light chain constant region variants. The insertion positions in Table 10 were located at the constant region side next to the described amino acid position (Kabat numbering) in the antibody light chain variable region. The insertion positions in Table 11 were located at the variable region side next to the described amino acid position (EU numbering) in the antibody light chain constant region.

TABLE 10

| MRA Light Chain Variable Region Variants and Protease Cleavage Sequence Insertion Positions | | |
|---|---|---|
| MRA light chain variable region variant | Protease cleavage sequence insertion position (Kabat numbering) | SEQ ID NO |
| MRAVL007.12aa | 7 | 232 |
| MRAVL008.12aa | 8 | 233 |
| MRAVL009.12aa | 9 | 234 |
| MRAVL010.12aa | 10 | 235 |
| MRAVL011.12aa | 11 | 236 |
| MRAVL012.12aa | 12 | 237 |
| MRAVL013.12aa | 13 | 238 |
| MRAVL014.12aa | 14 | 239 |
| MRAVL015.12aa | 15 | 240 |
| MRAVL016.12aa | 16 | 241 |
| MRAVL017.12aa | 17 | 242 |
| MRAVL018.12aa | 18 | 243 |
| MRAVL039.12aa | 39 | 244 |
| MRAVL040.12aa | 40 | 245 |
| MRAVL041.12aa | 41 | 246 |
| MRAVL042.12aa | 42 | 247 |
| MRAVL043.12aa | 43 | 248 |
| MRAVL044.12aa | 44 | 249 |
| MRAVL045.12aa | 45 | 250 |
| MRAVL049.12aa | 49 | 251 |
| MRAVL050.12aa | 50 | 252 |
| MRAVL051.12aa | 51 | 253 |

TABLE 10-continued

MRA Light Chain Variable Region Variants and Protease Cleavage Sequence Insertion Positions

| MRA light chain variable region variant | Protease cleavage sequence insertion position (Kabat numbering) | SEQ ID NO |
|---|---|---|
| MRAVL052.12aa | 52 | 254 |
| MRAVL053.12aa | 53 | 255 |
| MRAVL054.12aa | 54 | 256 |
| MRAVL055.12aa | 55 | 257 |
| MRAVL056.12aa | 56 | 258 |
| MRAVL057.12aa | 57 | 259 |
| MRAVL058.12aa | 58 | 260 |
| MRAVL059.12aa | 59 | 261 |
| MRAVL060.12aa | 60 | 262 |
| MRAVL096.12aa | 96 | 263 |
| MRAVL097.12aa | 97 | 264 |
| MRAVL098.12aa | 98 | 265 |
| MRAVL099.12aa | 99 | 266 |
| MRAVL100.12aa | 100 | 267 |
| MRAVL101.12aa | 101 | 268 |
| MRAVL102.12aa | 102 | 269 |
| MRAVL103.12aa | 103 | 270 |
| MRAVL104.12aa | 104 | 271 |
| MRAVL105.12aa | 105 | 272 |
| MRAVL106.12aa | 106 | 273 |
| MRAVL107.12aa | 107 | 274 |

TABLE 11

MRA Light Chain Constant Region Variants and Protease Cleavage Sequence Insertion Positions

| MRA light chain constant region variant | Protease cleavage sequence insertion position (EU numbering) | SEQ ID NO |
|---|---|---|
| k0.108.12aa | 109 (Kabat numbering position 109) | 275 |
| k0.109.12aa | 110 (Kabat numbering position 110) | 276 |
| k0.110.12aa | 111 (Kabat numbering position 111) | 277 |
| k0.111.12aa | 112 (Kabat numbering position 112) | 278 |
| k0.112.12aa | 113 (Kabat numbering position 113) | 279 |
| k0.113.12aa | 114 (Kabat numbering position 114) | 280 |
| k0.115.12aa | 116 (Kabat numbering position 116) | 281 |
| k0.116.12aa | 117 (Kabat numbering position 117) | 282 |
| k0.117.12aa | 118 (Kabat numbering position 118) | 283 |
| k0.118.12aa | 119 (Kabat numbering position 119) | 284 |
| k0.119.12aa | 120 (Kabat numbering position 120) | 285 |
| k0.120.12aa | 121 (Kabat numbering position 121) | 286 |
| k0.121.12aa | 122 (Kabat numbering position 122) | 287 |
| k0.122.12aa | 123 (Kabat numbering position 123) | 288 |
| k0.123.12aa | 124 (Kabat numbering position 124) | 289 |
| k0.124.12aa | 125 (Kabat numbering position 125) | 290 |
| k0.125.12aa | 126 (Kabat numbering position 126) | 291 |
| k0.126.12aa | 127 (Kabat numbering position 127) | 292 |
| k0.127.12aa | 128 (Kabat numbering position 128) | 293 |
| k0.128.12aa | 129 (Kabat numbering position 129) | 294 |
| k0.129.12aa | 130 (Kabat numbering position 130) | 295 |
| k0.130.12aa | 131 (Kabat numbering position 131) | 296 |

MRA variants shown in Table 12, prepared by combining the above-prepared MRA light chain variant with the MRA heavy chain, were transiently expressed using FreeStyle™ 293 cells (Invitrogen Corp.) or Expi293™ cells (Life Technologies Corp.) according to a method known to those skilled in the art, and purified using protein A according to a method known to those skilled in the art.

TABLE 12

MRA Variants

| Antibody name | Heavy chain SEQ ID NO | Light chain SEQ ID NO |
|---|---|---|
| MRAH-G1T4/MRAVL007.12aa-k0 | 147 | 471 |
| MRAH-G1T4/MRAVL008.12aa-k0 | 147 | 472 |
| MRAH-G1T4/MRAVL009.12aa-k0 | 147 | 473 |
| MRAH-G1T4/MRAVL010.12aa-k0 | 147 | 474 |
| MRAH-G1T4/MRAVL011.12aa-k0 | 147 | 475 |
| MRAH-G1T4/MRAVL012.12aa-k0 | 147 | 476 |
| MRAH-G1T4/MRAVL013.12aa-k0 | 147 | 477 |
| MRAH-G1T4/MRAVL014.12aa-k0 | 147 | 478 |
| MRAH-G1T4/MRAVL015.12aa-k0 | 147 | 479 |
| MRAH-G1T4/MRAVL016.12aa-k0 | 147 | 480 |
| MRAH-G1T4/MRAVL017.12aa-k0 | 147 | 481 |
| MRAH-G1T4/MRAVL018.12aa-k0 | 147 | 482 |

TABLE 12-continued

MRA Variants

| Antibody name | Heavy chain SEQ ID NO | Light chain SEQ ID NO |
|---|---|---|
| MRAH-G1T4/MRAVL039.12aa-k0 | 147 | 483 |
| MRAH-G1T4/MRAVL040.12aa-k0 | 147 | 484 |
| MRAH-G1T4/MRAVL041.12aa-k0 | 147 | 485 |
| MRAH-G1T4/MRAVL042.12aa-k0 | 147 | 486 |
| MRAH-G1T4/MRAVL043.12aa-k0 | 147 | 487 |
| MRAH-G1T4/MRAVL044.12aa-k0 | 147 | 488 |
| MRAH-G1T4/MRAVL045.12aa-k0 | 147 | 489 |
| MRAH-G1T4/MRAVL049.12aa-k0 | 147 | 490 |
| MRAH-G1T4/MRAVL050.12aa-k0 | 147 | 491 |
| MRAH-G1T4/MRAVL051.12aa-k0 | 147 | 492 |
| MRAH-G1T4/MRAVL052.12aa-k0 | 147 | 493 |
| MRAH-G1T4/MRAVL053.12aa-k0 | 147 | 494 |
| MRAH-G1T4/MRAVL054.12aa-k0 | 147 | 495 |
| MRAH-G1T4/MRAVL055.12aa-k0 | 147 | 496 |
| MRAH-G1T4/MRAVL056.12aa-k0 | 147 | 497 |
| MRAH-G1T4/MRAVL057.12aa-k0 | 147 | 498 |
| MRAH-G1T4/MRAVL058.12aa-k0 | 147 | 499 |
| MRAH-G1T4/MRAVL059.12aa-k0 | 147 | 500 |
| MRAH-G1T4/MRAVL060.12aa-k0 | 147 | 501 |
| MRAH-G1T4/MRAVL096.12aa-k0 | 147 | 502 |
| MRAH-G1T4/MRAVL097.12aa-k0 | 147 | 503 |
| MRAH-G1T4/MRAVL098.12aa-k0 | 147 | 504 |
| MRAH-G1T4/MRAVL099.12aa-k0 | 147 | 505 |
| MRAH-G1T4/MRAVL100.12aa-k0 | 147 | 506 |
| MRAH-G1T4/MRAVL101.12aa-k0 | 147 | 507 |
| MRAH-G1T4/MRAVL102.12aa-k0 | 147 | 508 |
| MRAH-G1T4/MRAVL103.12aa-k0 | 147 | 509 |
| MRAH-G1T4/MRAVL104.12aa-k0 | 147 | 510 |
| MRAH-G1T4/MRAVL105.12aa-k0 | 147 | 511 |
| MRAH-G1T4/MRAVL106.12aa-k0 | 147 | 512 |
| MRAH-G1T4/MRAVL107.12aa-k0 | 147 | 513 |
| MRAH-G1T4/MRAL-k0.108.12aa | 147 | 514 |
| MRAH-G1T4/MRAL-k0.109.12aa | 147 | 515 |
| MRAH-G1T4/MRAL-k0.110.12aa | 147 | 516 |
| MRAH-G1T4/MRAL-k0.111.12aa | 147 | 517 |
| MRAH-G1T4/MRAL-k0.112.12aa | 147 | 518 |
| MRAH-G1T4/MRAL-k0.113.12aa | 147 | 519 |
| MRAH-G1T4/MRAL-k0.115.12aa | 147 | 520 |
| MRAH-G1T4/MRAL-k0.116.12aa | 147 | 521 |
| MRAH-G1T4/MRAL-k0.117.12aa | 147 | 522 |
| MRAH-G1T4/MRAL-k0.118.12aa | 147 | 523 |
| MRAH-G1T4/MRAL-k0.119.12aa | 147 | 524 |
| MRAH-G1T4/MRAL-k0.120.12aa | 147 | 525 |
| MRAH-G1T4/MRAL-k0.121.12aa | 147 | 526 |
| MRAH-G1T4/MRAL-k0.122.12aa | 147 | 527 |
| MRAH-G1T4/MRAL-k0.123.12aa | 147 | 528 |
| MRAH-G1T4/MRAL-k0.124.12aa | 147 | 529 |
| MRAH-G1T4/MRAL-k0.125.12aa | 147 | 530 |
| MRAH-G1T4/MRAL-k0.126.12aa | 147 | 531 |
| MRAH-G1T4/MRAL-k0.127.12aa | 147 | 532 |
| MRAH-G1T4/MRAL-k0.128.12aa | 147 | 533 |
| MRAH-G1T4/MRAL-k0.129.12aa | 147 | 534 |
| MRAH-G1T4/MRAL-k0.130.12aa | 147 | 535 |

13-2. Evaluation of Protease Cleavage of Anti-Human IL-6R Neutralizing Antibody with Protease Cleavage Sequence Introduced in its Antibody Light Chain Variable Region Whether the MRA variants prepared in 13-1 would be cleaved by protease was verified. Recombinant Human Matriptase/ST14 Catalytic Domain (MT-SP1) (R&D Systems, Inc., 3946-SE-010) was used as the protease. 10 nM protease and 50 μg/mL of each antibody were reacted in PBS under a condition of 37° C. for 20 hours, followed by reducing SDS-PAGE. The results are shown in FIGS. 24A, 24B, 24C, 24D, 24E, 25A, and 25B. The protease-treated MRA variants which underwent cleavage generated a light chain band at a position with a smaller molecular weight than that of the light chains of protease-untreated MRA variants (a band appearing around 25 kDa in the MT-SP1 (−) lane in the drawings).

Example 14 Preparation of Anti-Human PD-1 Neutralizing Antibody with Introduced Protease Cleavage Sequence, and Evaluation of Binding Thereof to Human PD-1

14-1. Introduction of Protease Cleavage Sequence to Anti-Human PD-1 Neutralizing Antibody A protease cleavage sequence was inserted into the heavy or light chain of 5C4H-G1T4/5C4L-KT0 (heavy chain: 5C4H-G1T4, SEQ ID NO: 297; heavy chain variable region:

5C4H, SEQ ID NO: 300; heavy chain constant region: G1T4, SEQ ID NO: 301; light chain: 5C4L-KT0, SEQ ID NO: 298; light chain variable region: 5C4L, SEQ ID NO: 302; light chain constant region: KT0, SEQ ID NO: 303; H-CDR1 (NSGMH, SEQ ID NO: 392), H-CDR2 (VIWYDGSKRYYADSVKG, SEQ ID NO: 393), H-CDR3 (NDDY, SEQ ID NO: 394), L-CDR1 (RASQSVSSYLA, SEQ ID NO: 395), L-CDR2 (DASNRAT, SEQ ID NO: 396), L-CDR3 (QQSSNWPRT, SEQ ID NO: 397)), a neutralizing antibody against human PD1, to prepare an antibody with an introduced protease cleavage sequence.

First, a peptide sequence (SEQ ID NO: 299) reportedly cleavable by matriptase (MT-SP1) which is specifically expressed in a cancer, was inserted into the heavy chain 5C4H-G1T4 or the light chain 5C4L-KT0 of the antibody mentioned above, to prepare heavy chain variants shown in Table 13 and light chain variants shown in Table 14. These were expressed by a method known to those skilled in the art.

TABLE 13

Heavy Chain Variants of Anti-Human PD1 Neutralizing Antibody

| Heavy chain variant | SEQ ID NO | Protease cleavage sequence insertion position |
|---|---|---|
| 5C4HA12aa-G1T4 | 304 | Between variable region position 113 (Kabat numbering) and constant region position 118 (EU numbering) |
| 5C4HA12aa-G1T4E | 305 | Between constant region positions 118 and 119 (EU numbering) |

TABLE 14

Light Chain Variants of Anti-Human PD1 Neutralizing Antibody

| Light chain variant | SEQ ID NO | Protease cleavage sequence insertion position |
|---|---|---|
| 5C4LI12aa-KT0 | 306 | Between variable region positions 104 and 105 (Kabat numbering) |
| 5C4LC12aa-KT0 | 307 | Between variable region positions 105 and 106 (Kabat numbering) |
| 5C4LD12aa-KT0 | 308 | Between variable region positions 106 and 107 (Kabat numbering) |
| 5C4LA12aa-KT0 | 309 | Between variable region position 107 (Kabat numbering) and constant region position 108 (EU numbering) (constant region Kabat numbering position 108) |
| 5C4LE12aa-KT0E | 310 | Between constant region positions 108 and 109 (EU numbering) (between constant region Kabat numbering position 108 and constant region Kabat numbering position 109) |
| 5C4LB12aa-KT0B | 311 | Between constant region positions 109 and 110 (EU numbering) (between constant region Kabat numbering position 109 and constant region Kabat numbering position 110) |
| 5C4LF12aa-KT0F | 312 | Between constant region positions 110 and 111 (EU numbering) (between constant region Kabat numbering position 110 and constant region Kabat numbering position 111) |
| 5C4LG12aa-KT0G | 313 | Between constant region positions 111 and 112 (EU numbering) (between constant region Kabat numbering position 111 and constant region Kabat numbering position 112) |
| 5C4LJ12aa-KT0J | 314 | Between constant region positions 112 and 113 (EU numbering) (between constant region Kabat numbering position 112 and constant region Kabat numbering position 113) |
| 5C4LK12aa-KT0K | 315 | Between constant region positions 113 and 114 (EU numbering) (between constant region Kabat numbering position 113 and constant region Kabat numbering position 114) |

IgG1 antibodies (Table 15), prepared by combining the heavy chain variant of Table 13 with the light chain 5C4L-KT0, or by combining the light chain variant of Table 14 with the heavy chain 5C4H-G1T4, and introducing protease cleavage sequence, were transiently expressed using Expi293™ (Life Technologies Corp.) according to a method known to those skilled in the art, and purified using protein A according to a method known to those skilled in the art. 5C4H-GlT4/5C4L-KT0 (heavy chain: SEQ ID NO: 297, light chain: SEQ ID NO: 298) was expressed and purified as a control antibody containing no protease cleavage sequence.

TABLE 15

Antibodies with Introduced Protease Cleavage Sequence

| Antibody with introduced protease cleavage sequence | Heavy chain SEQ ID NO | Light chain SEQ ID NO |
|---|---|---|
| 5C4HA12aa-G1T4/5C4L-KT0 | 304 | 298 |
| 5C4HE12aa-G1T4E/5C4L-KT0 | 305 | 298 |
| 5C4H-G1T4/5C4LI12aa-KT0 | 297 | 306 |
| 5C4H-G1T4/5C4LC12aa-KT0 | 297 | 307 |
| 5C4H-G1T4/5C4LD12aa-KT0 | 297 | 308 |
| 5C4H-G1T4/5C4LA12aa-KT0 | 297 | 309 |
| 5C4H-G1T4/5C4LE12aa-KT0E | 297 | 310 |
| 5C4H-G1T4/5C4LB12aa-KT0B | 297 | 311 |
| 5C4H-G1T4/5C4LF12aa-KT0F | 297 | 312 |
| 5C4H-G1T4/5C4LG12aa-KT0G | 297 | 313 |
| 5C4H-G1T4/5C4LJ12aa-KT0J | 297 | 314 |
| 5C4H-G1T4/5C4LK12aa-KT0K | 297 | 315 |

14-2. Evaluation of Anti-Human PD-1 Neutralizing Antibody with Introduced Protease Cleavage Sequence, for Binding to Human PD-1

14-2-1. Protease Treatment

For protease-treated antibodies, 10 µL of Recombinant Human Matriptase/ST14 Catalytic Domain (hMT-SP1, R&D Systems, Inc., 3946-SE-010) adjusted to 1.8 µg/mL with PBS was added to each antibody (final concentration: 0.111 mg/mL) prepared in 14-1. For protease-untreated antibodies, 10 µL of only PBS was added to each antibody (final concentration: 0.111 mg/mL) prepared in 14-1. The sample volume at reaction was 90 µL, and the final concentration of the protease was 0.2 µg/mL. Each sample was incubated at 37° C. for 12 hours.

14-2-2. Preparation of Biotinylated Anti-Human PD-1 Neutralizing Antibody

A biotinylated anti-human PD-1 neutralizing antibody having the same variable region sequence as that of 5C4H-G1T4/5C4L-KT0 was prepared. Specifically, a gene fragment encoding 5C4VH-G1dGSBAP (SEQ ID NO: 317) containing an antibody heavy chain constant region and biotin (AviTag sequence, SEQ ID NO: 316) attached to a heavy chain variable region 5C4H (SEQ ID NO: 300) was prepared and introduced into a vector for expression in animal cells by a method known to those skilled in the art. The constructed expression vector and a vector for the expression of a light chain 5C4L-KT0B (SEQ ID NO: 298) were transfected into FreeStyle™ 293 cells (Invitrogen Corp.) using 293Fectin (Invitrogen Corp.). When doing so, the cells were cotransfected with a gene expressing EBNA1 (SEQ ID NO: 318) and a gene expressing biotin ligase (BirA; SEQ ID NO: 319), and biotin was added thereto for the purpose of biotin labeling. The cells thus transfected were cultured at 37° C. under 8% $CO_2$ and allowed to secrete the biotinylated anti-human PD-1 neutralizing antibody of interest (5C4-bio) into the culture supernatant. 5C4-bio was purified from the culture supernatant by a method known to those skilled in the art.

14-2-3. Evaluation of Each Antibody Before and After Protease Treatment for Binding to Human PD-1

Human PD-1 was added at a final concentration of 0.67 µM to 80 µL of each protease-treated antibody or protease-untreated antibody prepared in 14-2-1, and allowed to bind at room temperature for 30 minutes to prepare samples for binding evaluation. The amount of PD-1 unbound with the antibody was evaluated to evaluate the binding of the antibody to PD-1 with or without protease treatment.

Specifically, the amount of PD-1 unbound with the antibody was evaluated by bio-layer interferometry (BLI) using the biotinylated anti-human PD-1 neutralizing antibody (5C4-bio) prepared in Example 14-2-2.

Figure 26:
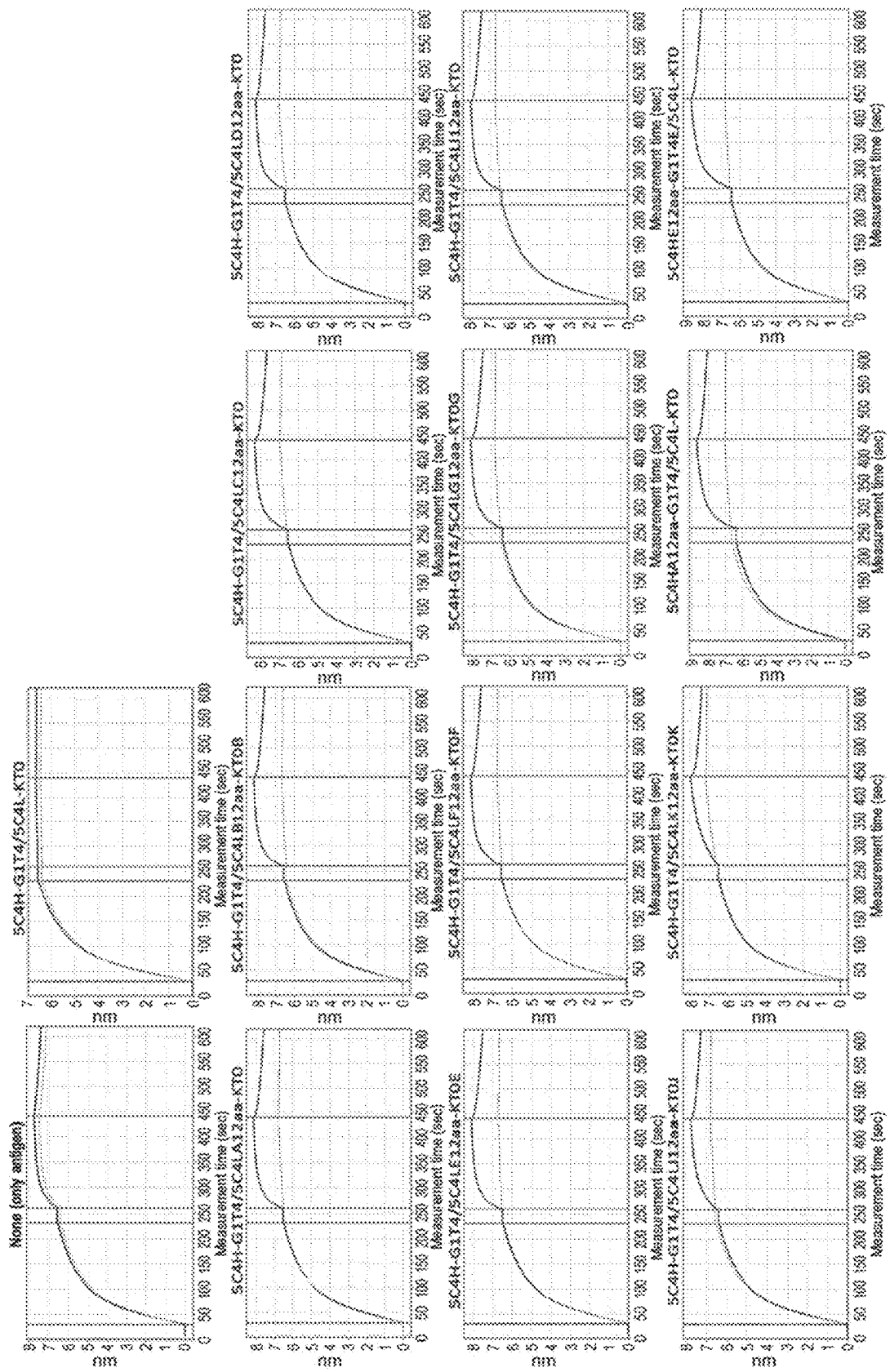

The samples for binding evaluation, 5C4-bio, and PBS were each dispensed to different wells of Tilted bottom (TW384) Microplates (Pall ForteBio Corp., 18-5076). A streptavidin biosensor (Pall ForteBio Corp., 18-0009) was hydrated using PBS, followed by measurement using Octet® RED 384 set to 30° C. Baseline measurement was carried out for 30 seconds in the wells containing PBS. Then, 5C4-bio was allowed to bind to the streptavidin sensor for 200 seconds. Baseline measurement was carried out again for 30 seconds in the wells containing PBS. Then, binding was measured for 180 seconds in the wells containing the samples for binding evaluation, and dissociation was measured for 180 seconds in the wells containing PBS. Real-time binding graphs showing binding patterns are shown in FIG. 26. As shown in FIG. 26, in the case of the antibodies with an introduced protease cleavage sequence, the measured amount of human PD-1 bound to 5C4-bio was larger in the samples for binding evaluation containing the protease-treated antibodies than in the samples for binding evaluation containing the protease-untreated antibodies. Thus, the PD-1 binding activity of each antibody with an introduced protease cleavage sequence was attenuated by protease treatment, so that PD-1 was released therefrom to bind to 5C4-bio.

14-2-4. Confirmation of Protease Cleavage of Antibody (SDS-PAGE)

Figure 27:
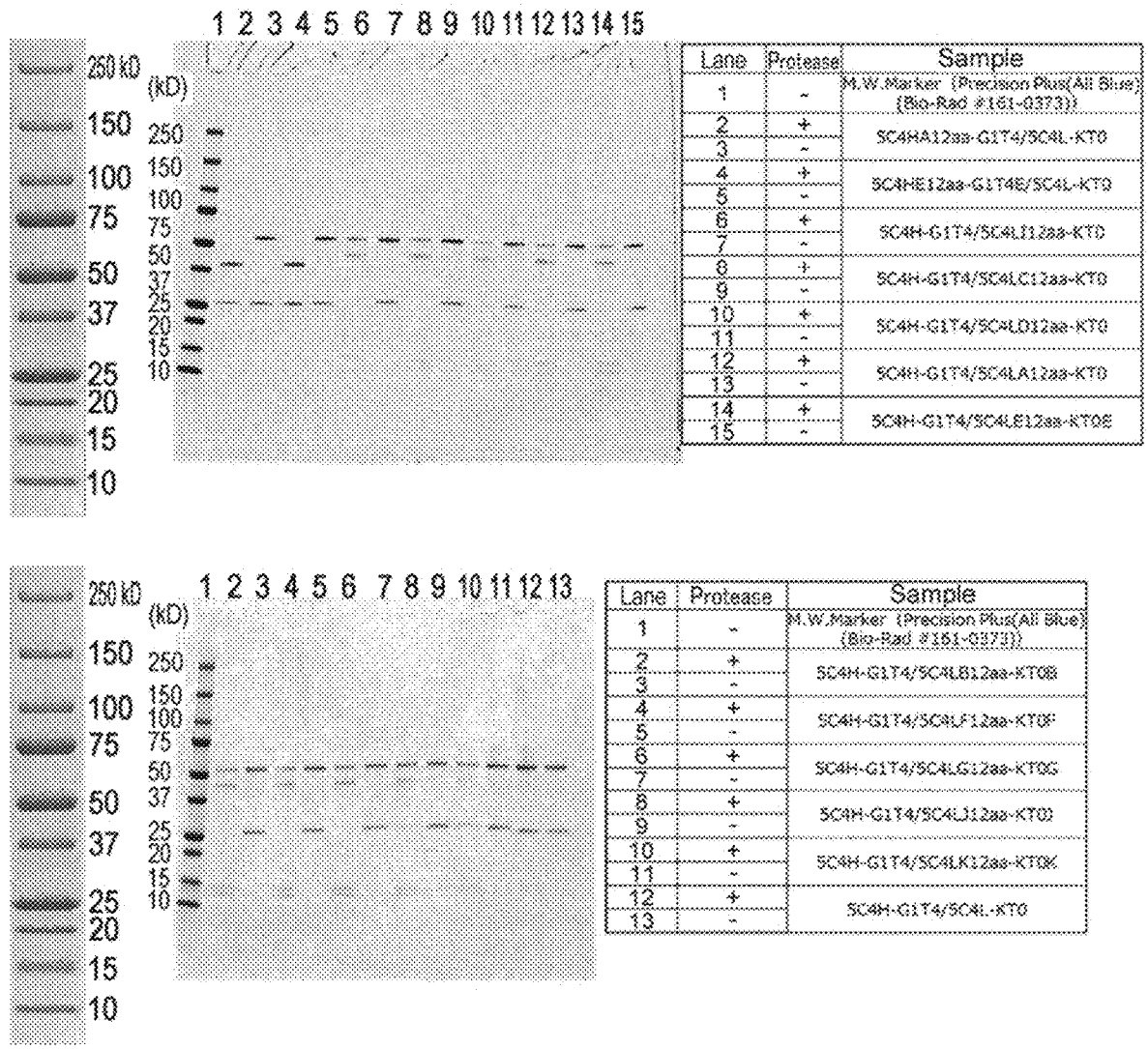

Whether the antibodies used in 14-2-3 were cleaved by protease treatment was confirmed by SDS-PAGE. 10 µL of each protease-cleaved antibody or protease-untreated antibody prepared in 14-2-3 was mixed with 3.3 µL of a sample buffer and incubated at 95° C. for 5 minutes. Next, electrophoresis was performed using Mini-PROTEAN® TGX gel (4-20% 15 wells) (Bio-Rad Laboratories, Inc., #456-1096), and proteins were stained with Sample Blue Safe Stain (Novex, LC6065). The results are shown in FIG. 27. As shown in FIG. 27, each antibody with an introduced protease cleavage sequence was cleaved by protease treatment.

Figure 28:
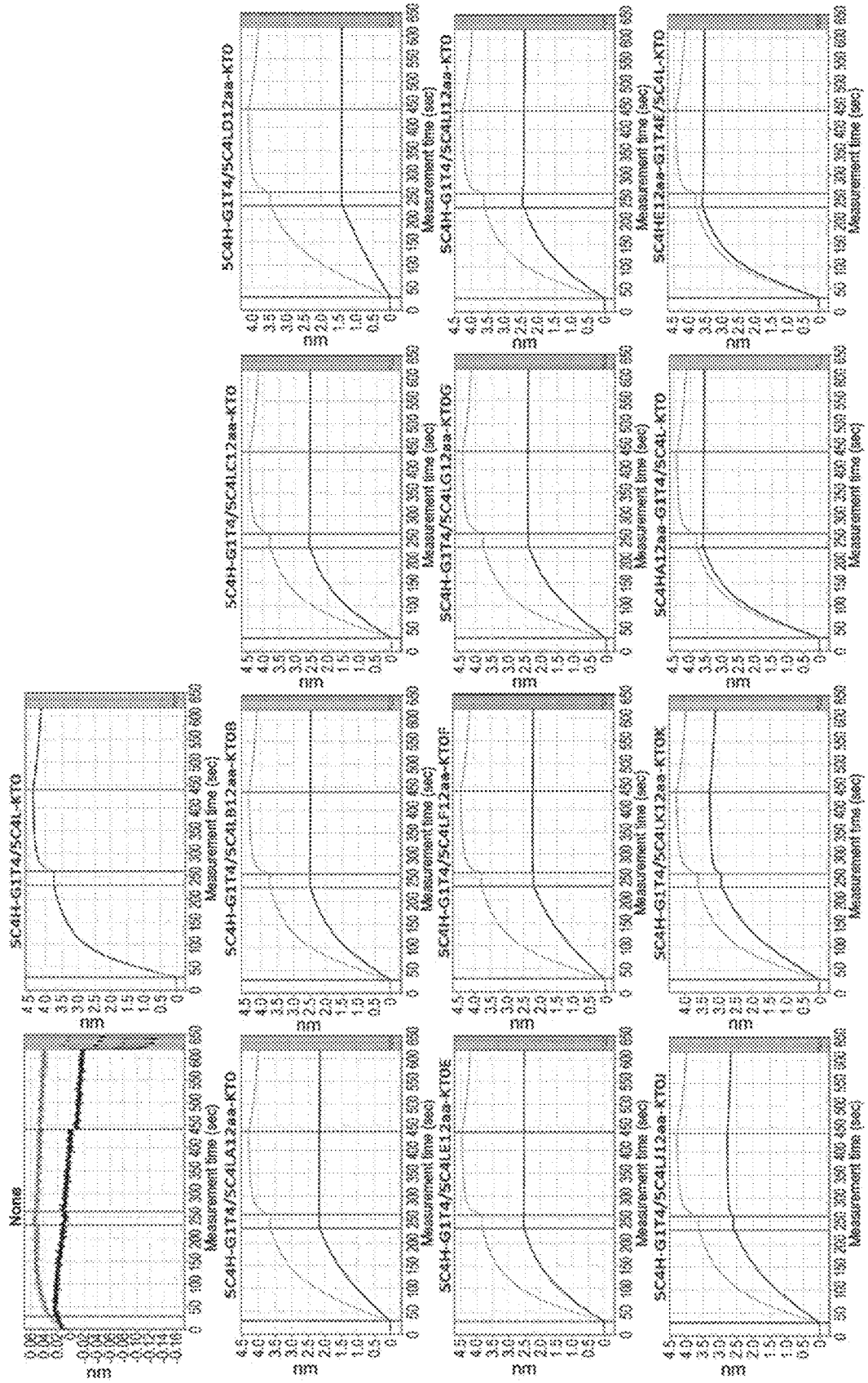
Figure 29:
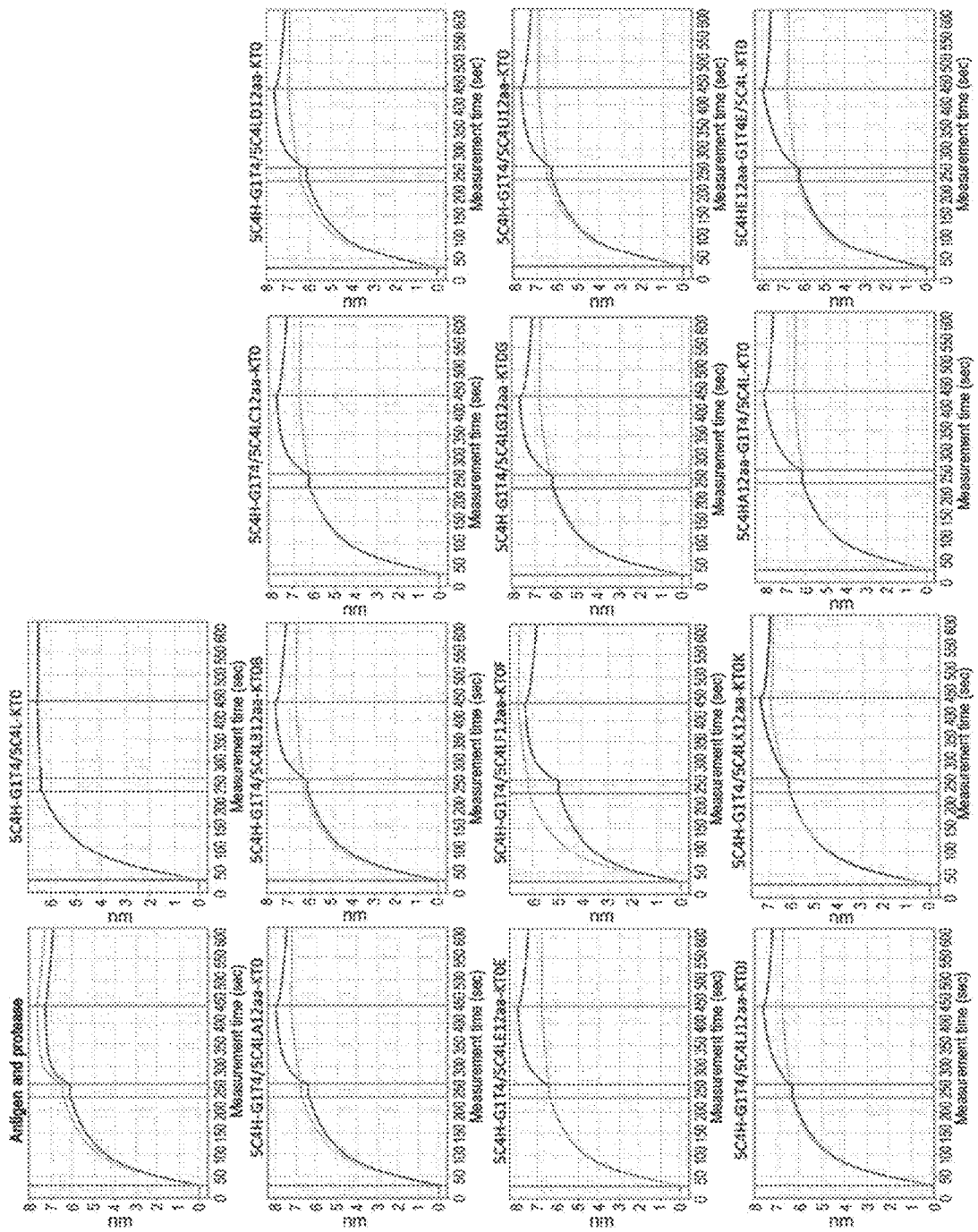
Figure 30:
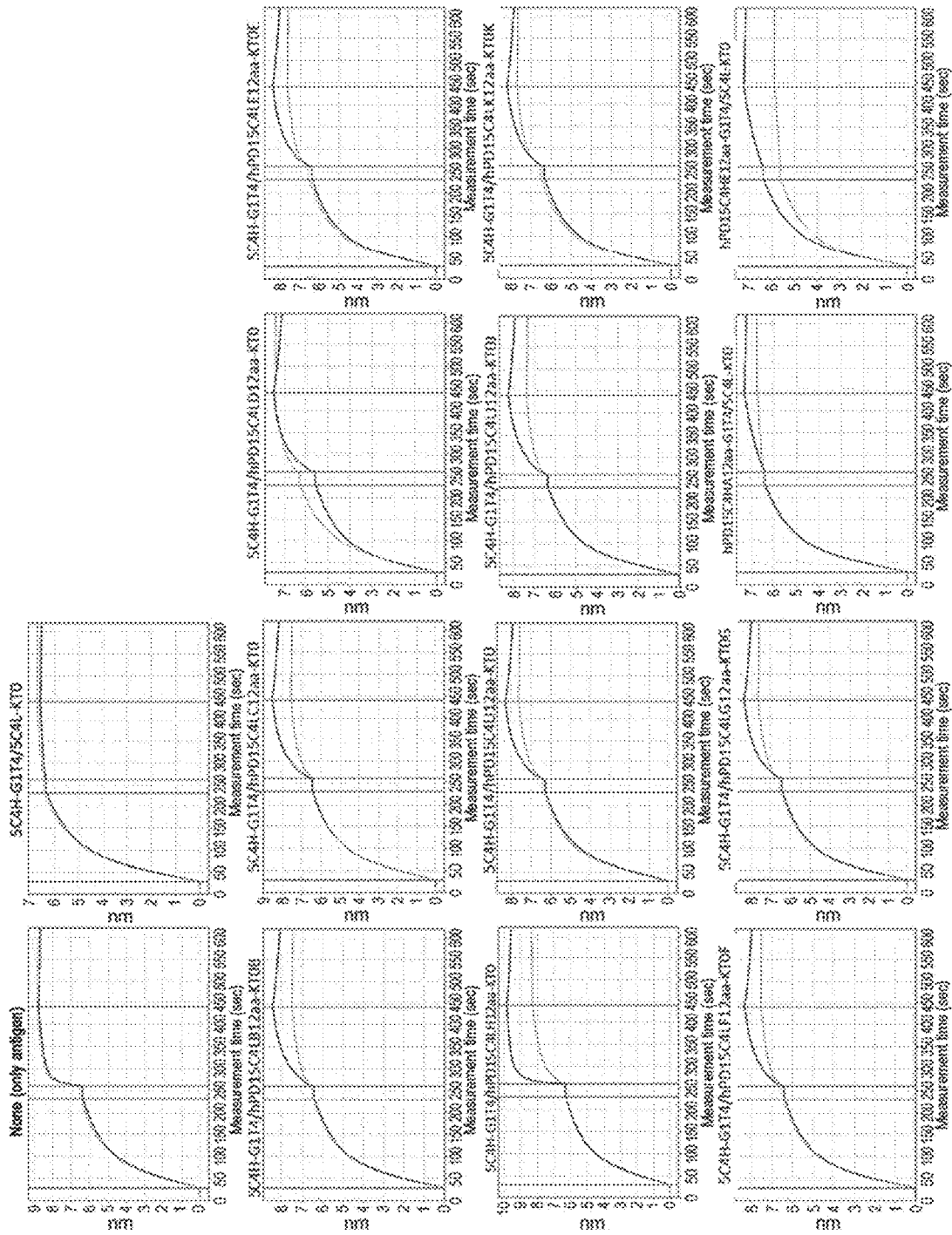
Figure 31:
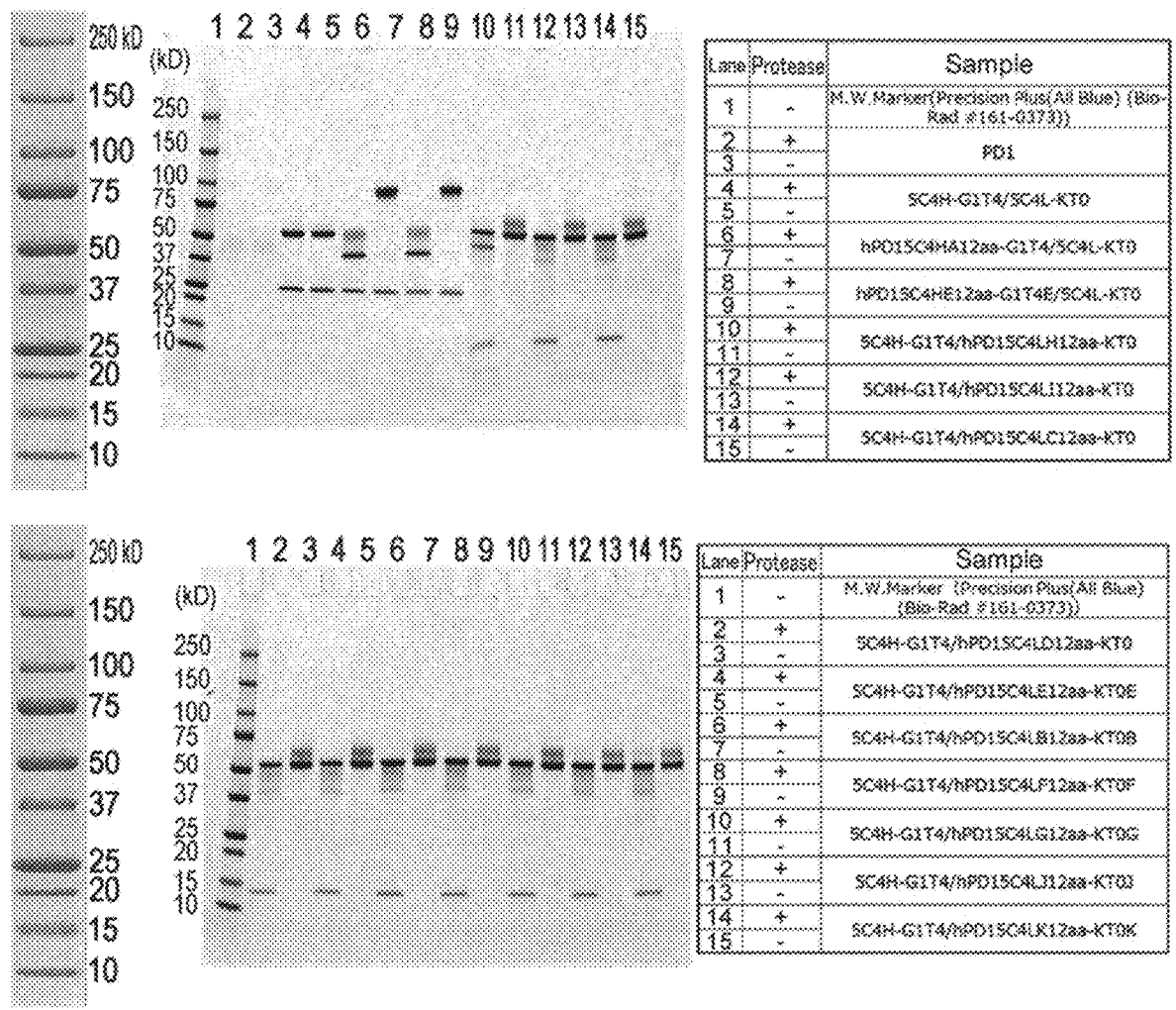

14-2-5. Evaluation of of Antibody Before and After Protease Treatment for PD-1 Binding The PD1 binding activity of each antibody with an introduced protease cleavage sequence before and after protease treatment was also measured by another method. 10 µL of each protease-treated antibody or protease-untreated antibody prepared in Example 14-2-1 was mixed with 70 µL of PBS to prepare PD-1 binding assay samples. The PD-1 binding of the samples was evaluated by bio-layer interferometry (BLI). The protease-treated antibodies or the protease-untreated antibodies prepared in Example 14-2-1 and human PD-1 (250 nM) were dispensed to different wells of Tilted bottom (TW384) Microplates (Pall ForteBio Corp., 18-5076). A protein G sensor (Pall ForteBio Corp., 18-0022) was hydrated using PBS, followed by assay using Octet® RED 384 set to 30° C. Baseline measurement was carried out for 30 seconds in the wells containing PBS. Then, the antibodies were allowed to bind to the protein G sensor for 200 seconds. Baseline measurement was carried out again for 30 seconds in the wells containing PBS. Then, binding was measured for 180 seconds in the wells containing human PD-1, and dissociation was measured for 180 seconds in the wells containing PBS. Real-time binding graphs showing binding patterns are shown in FIG. 28. As shown in FIG. 28, in the case of using each antibody with an introduced protease cleavage sequence, the amount of antibody bound to human PD-1 was decreased for the protease-treated antibody compared with the protease-untreated antibody.

14-3. Evaluation of Protease-Mediated Ligand Release of Complex of Ligand (Human PD-1) and Anti-Human PD-1 Neutralizing Antibody with Introduced Protease Cleavage Sequence 14-3-1. Protease Treatment in the Presence of Ligand 10 µL of human PD-1 adjusted to 6.67 µM with PBS was added to each antibody (final concentration: 0.100 mg/mL) prepared in 14-1 to prepare antibody-PD-1 complex solutions. For protease-treated samples, 10 μL of Recombinant Human Matriptase/ST14 Catalytic Domain (hMT-SP1, R&D Systems, Inc., 3946-SE-010) adjusted to 5.28 μg/mL with PBS was added to each antibody-PD-1 complex solution. For protease-untreated samples, 10 μL of only PBS was added thereto. The final concentration of the protease during reaction was 0.528 μg/mL. Each sample was incubated at 37° C. for 12 hours.

14-3-2. Evaluation of PD-1 Release after Protease Treatment

The amount of PD-1 not forming a complex with the antibody was evaluated by bio-layer interferometry (BLI) using the biotinylated anti-human PD-1 neutralizing antibody (5C4-bio) prepared in Example 14-2-2.

Each sample prepared in 14-3-1, 5C4-bio, and PBS were each dispensed to different wells of Tilted bottom (TW384) Microplates (Pall ForteBio Corp., 18-5076). A streptavidin biosensor (Pall ForteBio Corp., 18-0009) was hydrated using PBS, followed by measurement using Octet® RED 384 set to 30° C. Baseline measurement was carried out for 30 seconds in the wells containing PBS. Then, 5C4-bio was allowed to bind to the streptavidin sensor for 200 seconds. Baseline measurement was carried out again for 30 seconds in the wells containing PBS. Then, binding was measured for 180 seconds in the wells containing the protease-treated samples or the protease-untreated samples, and dissociation was measured for 180 seconds in the wells containing PBS. Real-time binding graphs showing binding patterns are shown in FIG. 29. As shown in FIG. 29, as for each antibody with an introduced protease cleavage sequence, the amount of human PD-1 bound to 5C4-bio was increased in the protease-treated sample compared with the protease-untreated sample. Thus, the PD-1 binding activity of each antibody was attenuated by protease treatment, so that PD-1 was detached and released from the antibody-PD-1 complex.

Example 15 Preparation and Evaluation of Fusion Protein of Anti-Human PD-1 Neutralizing Antibody with Introduced Protease Cleavage Sequence and Human PD-1 (Anti-PD-1 Neutralizing Antibody-PD-1 Fusion Protein)

15-1. Preparation of Fusion Protein of Anti-Human PD-1 Neutralizing Antibody and Human PD-1

A human PD-1 sequence (SEQ ID NO: 320) was connected to the N-terminus of the heavy chain or the heavy chain variant of each antibody prepared in Example 14-1 via a flexible linker consisting of a glycine-serine polymer (SEQ ID NO: 321) to prepare PD-1-fused heavy chains (Table 16).

TABLE 16

PD1-Fused Heavy Chains

| Heavy chain/ heavy chain variant | Presence or absence of protease cleavage sequence insertion | PD1-fused heavy chain |
|---|---|---|
| 5C4HA12aa-G1T4 (SEQ ID NO: 304) | Present | hPD15C4HA12aa-G1T4 (SEQ ID NO: 323) |
| 5C4HE12aa-G1T4E (Heavy chain SEQ ID NO: 305) | Present | hPD15C4HE12aa-G1T4E (SEQ ID NO: 324) |

Also, a human PD-1 sequence (SEQ ID NO: 320) was connected to the N-terminus of the light chain or the light chain variant of each antibody prepared in Example 14-1 via a flexible linker consisting of a glycine-serine polymer (SEQ ID NO: 321) to prepare PD-1-fused light chains (Table 17).

TABLE 17

PD1-Fused Light Chains

| Light chain/ light chain variant | Presence or absence of protease cleavage sequence insertion | PD1-fused light chain |
|---|---|---|
| 5C4LH12aa-KT0 (SEQ ID NO: 322) | Absent | hPD15C4LH12aa-KT0 (SEQ ID NO: 325) |
| 5C4LI12aa-KT0 (SEQ ID NO: 306) | Present | hPD15C4LI12aa-KT0 (SEQ ID NO: 326) |
| 5C4LC12aa-KT0 (SEQ ID NO: 307) | Present | hPD15C4LC12aa-KT0 (SEQ ID NO: 327) |
| 5C4LD12aa-KT0 (SEQ ID NO: 308) | Present | hPD15C4LD12aa-KT0 (SEQ ID NO: 328) |
| 5C4LE12aa-KT0E (SEQ ID NO: 310) | Present | hPD15C4LE12aa-KT0E (SEQ ID NO: 329) |
| 5C4LB12aa-KT0B (SEQ ID NO: 311) | Present | hPD15C4LB12aa-KT0B (SEQ ID NO: 330) |
| 5C4LF12aa-KT0F (SEQ ID NO: 312) | Present | hPD15C4LF12aa-KT0F (SEQ ID NO: 331) |

TABLE 17-continued

PD1-Fused Light Chains

| Light chain/ light chain variant | Presence or absence of protease cleavage sequence insertion | PD1-fused light chain |
|---|---|---|
| 5C4LG12aa-KT0G (SEQ ID NO: 313) | Present | hPD15C4LG12aa-KT0G (SEQ ID NO:332) |
| 504LJ12aa-KT0J (SEQ ID NO: 314) | Present | hPD15C4LJ12aa-KT0J (SEQ ID NO: 333) |
| 5C4LK12aa-KT0K (SEQ ID NO: 315) | Present | hPD15C4LK12aa-KT0K (SEQ ID NO: 334) |

The following anti-PD-1 neutralizing antibody-PD1 fusion proteins:
  hPD15C4HA12aa-G1T4/5C4L-KT0 (PD-1-fused heavy chain: SEQ ID NO: 323, light chain: SEQ ID NO: 298),
  hPD15C4HE12aa-G1T4E/5C4L-KT0 (PD-1-fused heavy chain: SEQ ID NO: 324, light chain: SEQ ID NO: 298),
  5C4H-G1T4/hPD15C4LH12aa-KT0 (heavy chain: SEQ ID NO: 297, PD-1-fused light chain: SEQ ID NO: 325),
  5C4H-G1T4/hPD15C4LI12aa-KT0 (heavy chain: SEQ ID NO: 297, PD-1-fused light chain: SEQ ID NO: 326),
  5C4H-G1T4/hPD15C4LC12aa-KT0 (heavy chain: SEQ ID NO: 297, PD-1-fused light chain: SEQ ID NO: 327),
  5C4H-G1T4/hPD15C4LD12aa-KT0 (heavy chain: SEQ ID NO: 297, PD-1-fused light chain: SEQ ID NO: 328),
  5C4H-G1T4/hPD15C4LE12aa-KT0E (heavy chain: SEQ ID NO: 297, PD-1-fused light chain: SEQ ID NO: 329),
  5C4H-G1T4/hPD15C4LB12aa-KT0B (heavy chain: SEQ ID NO: 297, PD-1-fused light chain: SEQ ID NO: 330),
  5C4H-G1T4/hPD15C4LF12aa-KT0F (heavy chain: SEQ ID NO: 297, PD-1-fused light chain: SEQ ID NO: 331),
  5C4H-G1T4/hPD15C4LG12aa-KT0G (heavy chain: SEQ ID NO: 297, PD-1-fused light chain: SEQ ID NO: 332),
  5C4H-G1T4/hPD15C4LJ12aa-KT0J (heavy chain: SEQ ID NO: 297, PD-1-fused light chain: SEQ ID NO: 333), and
  5C4H-G1T4/hPD15C4LK12aa-KT0K (heavy chain: SEQ ID NO: 297, PD-1-fused light chain: SEQ ID NO: 334)
in which the PD-1-fused heavy chain shown in Table 16 and the light chain 5C4L-KT0 are combined or the PD-1-fused light chain shown in Table 17 and the heavy chain 5C4H-G1T4 are combined were transiently expressed using Expi293™ (Life Technologies Corp.) according to a method known to those skilled in the art, and purified using protein A according to a method known to those skilled in the art. Likewise, 5C4H-G1T4/5C4L-KT0 (heavy chain: SEQ ID NO: 297, light chain: SEQ ID NO: 298) was expressed and purified as a control antibody containing no protease cleavage sequence.

15-2. Evaluation of Anti-PD-1 Neutralizing Antibody-PD-1 Fusion Protein for Protease Cleavage 15-2-1. Protease Treatment For protease-treated fusion proteins, 4.9 µL of Recombinant Human Matriptase/ST14 Catalytic Domain (hMT-SP1, R&D Systems, Inc., 3946-SE-010) adjusted to 16.7 μg/mL with PBS was added to 30 μg of each fusion protein prepared in Example 15-1. For protease-untreated fusion proteins, 4.9 μL of only PBS was added to 30 μg of each fusion protein prepared in Example 15-1. The protease-treated fusion proteins or the protease-untreated fusion proteins were incubated at 37° C. for 12 hours.

15-2-2. Evaluation of PD-1 Release by Protease Treatment

PD-1 release by protease treatment was evaluated by bio-layer interferometry (BLI) using the biotinylated anti-human PD-1 neutralizing antibody (5C4-bio) prepared in Example 14-2-2.

The protease-treated fusion proteins or the protease-untreated fusion proteins prepared in Example 15-2-1, 5C4-bio, and PBS were dispensed to different wells of Tilted bottom (TW384) Microplates (Pall ForteBio Corp., 18-5076). A streptavidin biosensor (Pall ForteBio Corp., 18-0009) was hydrated using PBS, followed by assay using Octet® RED 384 set to 30° C. Baseline measurement was carried out for 30 seconds in the wells containing PBS. Then, 5C4-bio was allowed to bind to the streptavidin sensor for 200 seconds. Baseline measurement was carried out again for 30 seconds in the wells containing PBS. Then, binding was measured for 180 seconds in the wells containing the protease-treated fusion proteins or the protease-untreated fusion proteins, and dissociation was measured for 180 seconds in the wells containing PBS. Real-time binding graphs showing binding patterns are shown in FIG. 30. As shown in FIG. 30, as for each antibody-PD-1 fusion protein containing the antibody with an introduced protease cleavage sequence, the amount of human PD-1 bound to 5C4-bio was increased in the protease-treated sample compared with the protease-untreated sample. Thus, the PD-1 binding activity of the antibody in each fusion protein was attenuated by protease treatment, so that PD-1 was released from the fusion protein.

15-2-3. Confirmation of Cleavage of Anti-PD-1 Neutralizing Antibody-PD-1 Fusion Protein (SDS-PAGE)

Whether the protease-treated fusion proteins prepared in 15-2-1 were cleaved by protease treatment was confirmed by SDS-PAGE. 10 μL of each protease-treated fusion protein or protease-untreated fusion protein prepared in 15-2-1 was mixed with 3.3 μL of a sample buffer and incubated at 95° C. for 5 minutes. Next, electrophoresis was performed using Mini-PROTEAN® TGX gel (4-20% 15 wells) (Bio-Rad Laboratories, Inc., #456-1096), and proteins were stained with Sample Blue Safe Stain (Novex, LC6065). The results are shown in FIG. 31. As shown in FIG. 31, each fusion protein containing the antibody with an introduced protease cleavage sequence was cleaved by protease treatment.

Example 16 Evaluation of Antibodies Prepared by Introducing Various Protease Cleavage Sequences into an Anti-Human CXCL10 Neutralizing Antibody 16-1. Preparation of Antibody Variants into which Various Protease Cleavage Sequences are Introduced The protease cleavage sequences shown in Table 18 were introduced near the boundary between the light chain variable region and constant region of MabCXCL10_G7 (heavy chain: G7H-G1T4 (SEQ ID NO: 368), light chain: G7L-LT0 (SEQ ID NO: 369)), an antibody neutralizing human CXCL10, to produce MabCXCL10_G7 light chain variants with different protease cleavage sequences (Table 19).

The protease cleavage sequence-containing light chain variants produced above were combined with the heavy chain, and the MabCXCL10_G7 variants shown in Table 20 were transiently expressed using Expi293™ cells (Life technologies) according to a method known to those skilled in the art, and purified using Protein A according to a method known to those skilled in the art.

TABLE 18

Protease Cleavage Sequences

| SEQ ID NO | Cleavage Sequence |
|---|---|
| 345 | TSTSGRSANPRG |
| 818 | TSYTGRSAVPRG |
| 819 | TSYSGRSAVYRG |
| 820 | TSYSGRSAVVRG |
| 821 | TSYSGRSAVHRG |
| 822 | TSYSGRSAVYRG |
| 823 | TSYTGRSAVVRG |
| 824 | TSYTGRSAVHRG |
| 830 | TSYTGRSAVPGG |
| 831 | TSYSGRSAVYGG |
| 832 | TSYSGRSAVVGG |
| 833 | TSYSGRSAVHGG |
| 834 | TSYTGRSAVYGG |
| 835 | TSYTGRSAVVGG |
| 836 | TSYTGRSAVHGG |

TABLE 19

MabCXCL10_G7 Light Chain Variants

| SEQ ID NO | Light chain variant name |
|---|---|
| 1146 | G7L.106a.12aa-LT0 |
| 1147 | G7L.12aa0089.001-LT0 |
| 1148 | G7L.12aa0089.002-LT0 |
| 1149 | G7L.12aa0089.003-LT0 |
| 1150 | G7L.12aa0089.004-LT0 |
| 1151 | G7L.12aa0089.005-LT0 |
| 1152 | G7L.12aa0089.006-LT0 |
| 1153 | G7L.12aa0089.007-LT0 |
| 1154 | G7L.12aa0089.001.R11G-LT0 |
| 1155 | G7L.12aa0089.002.R11G-LT0 |
| 1156 | G7L.12aa0089.003.R11G-LT0 |
| 1157 | G7L.12aa0089.004.R11G-LT0 |
| 1158 | G7L.12aa0089.005.R11G-LT0 |
| 1159 | G7L.12aa0089.006.R11G-LT0 |
| 1160 | G7L.12aa0089.007.R11G-LT0 |

TABLE 20

MabCXCL10_G7 Variants

| Antibody variant name | Heavy chain SEQ ID NO | Light chain SEQ ID NO |
|---|---|---|
| G7L.106a.12aa | 368 | 1146 |
| G7L.12aa0089.001 | 368 | 1147 |
| G7L.12aa0089.002 | 368 | 1148 |
| G7L.12aa0089.003 | 368 | 1149 |
| G7L.12aa0089.004 | 368 | 1150 |
| G7L.12aa0089.005 | 368 | 1151 |
| G7L.12aa0089.006 | 368 | 1152 |
| G7L.12aa0089.007 | 368 | 1153 |
| G7L.12aa0089.001.R11G | 368 | 1154 |
| G7L.12aa0089.002.R11G | 368 | 1155 |
| G7L.12aa0089.003.R11G | 368 | 1156 |
| G7L.12aa0089.004.R11G | 368 | 1157 |
| G7L.12aa0089.005.R11G | 368 | 1158 |
| G7L.12aa0089.006.R11G | 368 | 1159 |
| G7L.12aa0089.007.R11G | 368 | 1160 |

16-2. Evaluation of Protease Cleavage of Antibody Variants with an Introduced Protease Cleavage Sequence The antibody variants prepared in 16-1 were tested to see whether they would be cleaved by protease treatment. The protease used was recombinant human u-Plasminogen Activator/Urokinase (human uPA, huPA) (R&D Systems; 1310-SE-010). The antibody variants were allowed to react for one hour under the conditions of 40 nM protease, 100 µg/mL antibody variant, PBS, and 37° C., and then subjected to reducing SDS-PAGE. The results confirmed that all the protease cleavage sequence-introduced antibody variants were cleaved by protease treatment. That is, it was shown that the protease cleavage sequences in Table 18 can be cleaved by protease. In addition, the antibody variants other than G7L.106a.12aa were all cleaved more efficiently than G7L.106a.12aa.

Example 17 Studies on Protease Cleavage Sequences to be Introduced into an Anti-Human CXCL10 Neutralizing Antibody, and Evaluation of Antibodies into which the Cleavage Sequences are Introduced 17-1. Production of Antibody Variants into which a Protease Cleavage Sequence is Introduced In addition to the protease cleavage sequences discovered in Example 16, more protease cleavage sequences were studied in order to improve cleavage efficiency and protease selectivity. The protease cleavage sequences shown in Table 21 were inserted near the boundary between the light chain variable region and constant region of MabCXCL10_G7 (heavy chain: G7H-G1T4 (SEQ ID NO: 1181), light chain: G7L-LT0 (SEQ ID NO: 1182)), an antibody neutralizing human CXCL10, to produce MabCXCL10_G7 light chain variants with different protease cleavage sequences (Table 22).

The protease cleavage sequence-containing light chain variants produced above were combined with the heavy chain, and the MabCXCL10_G7 variants shown in Table 23 were produced by the same method as described in Example 16.

TABLE 21

Protease Cleavage Sequences

| SEQ ID NO | Cleavage sequence |
| --- | --- |
| 1183 | TSTSGRSANPRG |
| 1184 | TSTSGRSANPAG |
| 1185 | TSTSGRSANPHG |
| 1186 | TSTSGRSANPIG |
| 1187 | TSTSGRSANPLG |
| 1188 | TSTSGRSANPSG |
| 1189 | ISTSGRSANPIG |
| 1190 | YSTSGRSANPIG |
| 1191 | TSYSGRSAVPAG |
| 1192 | TSPSGRSANIAG |
| 1193 | TSPSGRSANFAG |
| 1194 | TSPTGRSANPAG |
| 1195 | TSPSGRSAIPAG |
| 1196 | TSYTGRSANPAG |
| 1197 | TSYSGRSAIPAG |
| 1198 | TSISGRSANYAG |
| 1199 | TSPSGRSAGPAG |
| 1200 | TSYTGRSAVPAG |
| 1201 | TSYTGRSAVYAG |
| 1202 | TSYTGRSAVVAG |
| 1203 | TSYTGRSAVHAG |
| 1204 | TSYSGRSAVPHG |
| 1205 | TSPSGRSANIHG |
| 1206 | TSPSGRSANFHG |
| 1207 | TSPTGRSANPHG |
| 1208 | TSPSGRSAIPHG |
| 1209 | TSYTGRSANPHG |
| 1210 | TSYSGRSAIPHG |
| 1211 | TSISGRSANYHG |
| 1212 | TSPSGRSAGPHG |
| 1213 | TSYTGRSAVPHG |
| 1214 | TSYTGRSAVYHG |
| 1215 | TSYTGRSAVVHG |
| 1216 | TSYTGRSAVHHG |
| 1217 | TSYSGRSAVPIG |

TABLE 21-continued

Protease Cleavage Sequences

| SEQ ID NO | Cleavage sequence |
| --- | --- |
| 1218 | TSPSGRSANIIG |
| 1219 | TSPSGRSANFIG |
| 1220 | TSPTGRSANPIG |
| 1221 | TSPSGRSAIPIG |
| 1222 | TSYTGRSANPIG |
| 1223 | TSYSGRSAIPIG |
| 1224 | TSISGRSANYIG |
| 1225 | TSPSGRSAGPIG |
| 1226 | TSYTGRSAVPIG |
| 1227 | TSYTGRSAVYIG |
| 1228 | TSYTGRSAVVIG |
| 1229 | TSYTGRSAVHIG |
| 1230 | TSYSGRSAVPLG |
| 1231 | TSPSGRSANILG |
| 1232 | TSPSGRSANFLG |
| 1233 | TSPTGRSANPLG |
| 1234 | TSPSGRSAIPLG |
| 1235 | TSYTGRSANPLG |
| 1236 | TSYSGRSAIPLG |
| 1237 | TSISGRSANYLG |
| 1238 | TSPSGRSAGPLG |
| 1239 | TSYTGRSAVPLG |
| 1240 | TSYTGRSAVYLG |
| 1241 | TSYTGRSAVVLG |
| 1242 | TSYTGRSAVHLG |
| 1243 | TSYSGRSAVPSG |
| 1244 | TSPSGRSANISG |
| 1245 | TSPSGRSANFSG |
| 1246 | TSPTGRSANPSG |
| 1247 | TSPSGRSAIPSG |
| 1248 | TSYTGRSANPSG |
| 1249 | TSYSGRSAIPSG |
| 1250 | TSISGRSANYSG |
| 1251 | TSPSGRSAGPSG |
| 1252 | TSYTGRSAVPSG |
| 1253 | TSYTGRSAVYSG |
| 1254 | TSYTGRSAVVSG |
| 1255 | TSYTGRSAVHSG |

TABLE 21-continued

Protease Cleavage Sequences

| SEQ ID NO | Cleavage sequence |
|---|---|
| 1256 | ISYSGRSAVPIG |
| 1257 | ISPSGRSANIIG |
| 1258 | ISPSGRSANFIG |
| 1259 | ISPTGRSANPIG |
| 1260 | ISPSGRSAIPIG |
| 1261 | ISYTGRSANPIG |
| 1262 | ISYSGRSAIPIG |
| 1263 | ISISGRSANYIG |
| 1264 | ISPSGRSAGPIG |
| 1265 | ISYTGRSAVPIG |
| 1266 | ISYTGRSAVYIG |
| 1267 | ISYTGRSAVVIG |
| 1268 | ISYTGRSAVHIG |
| 1269 | YSYSGRSAVPIG |
| 1270 | YSPSGRSANIIG |
| 1271 | YSPSGRSANFIG |
| 1272 | YSPTGRSANPIG |
| 1273 | YSPSGRSAIPIG |
| 1274 | YSYTGRSANPIG |
| 1275 | YSYSGRSAIPIG |
| 1276 | YSISGRSANYIG |
| 1277 | YSPSGRSAGPIG |
| 1278 | YSYTGRSAVPIG |
| 1279 | YSYTGRSAVYIG |
| 1280 | YSYTGRSAVVIG |
| 1281 | YSYTGRSAVHIG |

TABLE 22

MabCXCL10_G7 Light Chain Variants

| SEQ ID NO | Variant light chain name |
|---|---|
| 1282 | G7L.106a.12aa-LT0 |
| 1283 | G7L.12aa.0177-LT0 |
| 1284 | G7L.12aa.0180-LT0 |
| 1285 | G7L.12aa.0181-LT0 |
| 1286 | G7L.12aa.0182-LT0 |
| 1287 | G7L.12aa.0185-LT0 |
| 1288 | G7L.12aa0163-LT0 |

TABLE 22-continued

MabCXCL10_G7 Light Chain Variants

| SEQ ID NO | Variant light chain name |
|---|---|
| 1289 | G7L.12aa0166-LT0 |
| 1290 | G7L.12aa0089.0177-LT0 |
| 1291 | G7L.12aa0019.0177-LT0 |
| 1292 | G7L.12aa0020.0177-LT0 |
| 1293 | G7L.12aa0069.0177-LT0 |
| 1294 | G7L.12aa0071.0177-LT0 |
| 1295 | G7L.12aa0087.0177-LT0 |
| 1296 | G7L.12aa0090.0177-LT0 |
| 1297 | G7L.12aa0120.0177-LT0 |
| 1298 | G7L.12aa0157.0177-LT0 |
| 1299 | G7L.12aa0089.001.0177-LT0 |
| 1300 | G7L.12aa0089.005.0177-LT0 |
| 1301 | G7L12aa0089.006.0177-LT0 |
| 1302 | G7L.12aa0089.007.0177-LT0 |
| 1303 | G7L.12aa0089.0180-LT0 |
| 1304 | G7L.12aa0019.0180-LT0 |
| 1305 | G7L.12aa0020.0180-LT0 |
| 1306 | G7L.12aa0069.0180-LT0 |
| 1307 | G7L.12aa0071.0180-LT0 |
| 1308 | G7L.12aa0087.0180-LT0 |
| 1309 | G7L.12aa0090.0180-LT0 |
| 1310 | G7L.12aa0120.0180-LT0 |
| 1311 | G7L.12aa0157.0180-LT0 |
| 1312 | G7L.12aa0089.001.0180-LT0 |
| 1313 | G7L.12aa0089.005.0180-LT0 |
| 1314 | G7L.12aa0089.006.0180-LT0 |
| 1315 | G7L12aa0089.007.0180-LT0 |
| 1316 | G7L.12aa0089.0181-LT0 |
| 1317 | G7L.12aa0019.0181-LT0 |
| 1318 | G7L.12aa0020.0181-LT0 |
| 1319 | G7L.12aa0069.0181-LT0 |
| 1320 | G7L.12aa0071.0181-LT0 |
| 1321 | G7L.12aa0087.0181-LT0 |
| 1322 | G7L.12aa0090.0181-LT0 |
| 1323 | G7L.12aa0120.0181-LT0 |
| 1324 | G7L.12aa0157.0181-LT0 |
| 1325 | G7L.12aa0089.001.0181-LT0 |
| 1326 | G7L.12aa0089.005.0181-LT0 |

TABLE 22-continued

MabCXCL10_G7 Light Chain Variants

| SEQ ID NO | Variant light chain name |
|---|---|
| 1327 | G7L.12aa0089.006.0181-LT0 |
| 1328 | G7L.12aa0089.007.0181-LT0 |
| 1329 | G7L.12aa0089.0182-LT0 |
| 1330 | G7L.12aa0019.0182-LT0 |
| 1331 | G7L.12aa0020.0182-LT0 |
| 1332 | G7L.12aa0069.0182-LT0 |
| 1333 | G7L.12aa0071.0182-LT0 |
| 1334 | G7L.12aa0087.0182-LT0 |
| 1335 | G7L.12aa0090.0182-LT0 |
| 1336 | G7L.12aa0120.0182-LT0 |
| 1337 | G7L.12aa0157.0182-LT0 |
| 1338 | G7L.12aa0089.001.0182-LT0 |
| 1339 | G7L.12aa0089.005.0182-LT0 |
| 1340 | G7L.12aa0089.006.0182-LT0 |
| 1341 | G7L.12aa0089.007.0182-LT0 |
| 1342 | G7L.12aa0089.0185-LT0 |
| 1343 | G7L.12aa0019.0185-LT0 |
| 1344 | G7L.12aa0020.0185-LT0 |
| 1345 | G7L.12aa0069.0185-LT0 |
| 1346 | G7L.12aa0071.0185-LT0 |
| 1347 | G7L.12aa0087.0185-LT0 |
| 1348 | G7L.12aa0090.0185-LT0 |
| 1349 | G7L.12aa0120.0185-LT0 |
| 1350 | G7L.12aa0157.0185-LT0 |
| 1351 | G7L.12aa0089.001.0185-LT0 |
| 1352 | G7L.12aa0089.005.0185-LT0 |
| 1353 | G7L.12aa0089.006.0185-LT0 |
| 1354 | G7L.12aa0089.007.0185-LT0 |
| 1355 | G7L.12aa0089.0200-LT0 |
| 1356 | G7L.12aa0019.0200-LT0 |
| 1357 | G7L.12aa0020.0200-LT0 |
| 1358 | G7L.12aa0069.0200-LT0 |
| 1359 | G7L.12aa0071.0200-LT0 |
| 1360 | G7L.12aa0087.0200-LT0 |
| 1361 | G7L.12aa0090.0200-LT0 |
| 1362 | G7L.12aa0120.0200-LT0 |
| 1363 | G7L.12aa0157.0200-LT0 |
| 1364 | G7L.12aa0089.001.0200-LT0 |
| 1365 | G7L.12aa0089.005.0200-LT0 |
| 1366 | G7L.12aa0089.006.0200-LT0 |
| 1367 | G7L.12aa0089.007.0200-LT0 |
| 1368 | G7L.12aa0089.0203-LT0 |
| 1369 | G7L.12aa0019.0203-LT0 |
| 1370 | G7L.12aa0020.0203-LT0 |
| 1371 | G7L.12aa0069.0203-LT0 |
| 1372 | G7L.12aa0071.0203-LT0 |
| 1373 | G7L.12aa0087.0203-LT0 |
| 1374 | G7L.12aa0090.0203-LT0 |
| 1375 | G7L.12aa0120.0203-LT0 |
| 1376 | G7L.12aa0157.0203-LT0 |
| 1377 | G7L.12aa0089.001.0203-LT0 |
| 1378 | G7L.12aa0089.005.0203-LT0 |
| 1379 | G7L.12aa0089.006.0203-LT0 |
| 1380 | G7L.12aa0089.007.0203-LT0 |

TABLE 23

MabCXCL10_G7 Variants

| Antibody variant name | Heavy chain SEQ ID NO | Light chain SEQ ID NO |
|---|---|---|
| G7L.106a.12aa | 1181 | 1282 |
| G7L.12aa.0177 | 1181 | 1283 |
| G7L.12aa.0180 | 1181 | 1284 |
| G7L.12aa.0181 | 1181 | 1285 |
| G7L.12aa.0182 | 1181 | 1286 |
| G7L.12aa.0185 | 1181 | 1287 |
| G7L.12aa0163 | 1181 | 1288 |
| G7L.12aa0166 | 1181 | 1289 |
| G7L.12aa0089.0177 | 1181 | 1290 |
| G7L.12aa0019.0177 | 1181 | 1291 |
| G7L.12aa0020.0177 | 1181 | 1292 |
| G7L.12aa0069.0177 | 1181 | 1293 |
| G7L.12aa0071.0177 | 1181 | 1294 |
| G7L.12aa0087.0177 | 1181 | 1295 |
| G7L.12aa0090.0177 | 1181 | 1296 |
| G7L.12aa0120.0177 | 1181 | 1297 |
| G7L.12aa0157.0177 | 1181 | 1298 |

TABLE 23-continued

MabCXCL10_G7 Variants

| Antibody variant name | Heavy chain SEQ ID NO | Light chain SEQ ID NO |
|---|---|---|
| G7L.12aa0089.001.0177 | 1181 | 1299 |
| G7L.12aa0089.005.0177 | 1181 | 1300 |
| G7L.12aa0089.006.0177 | 1181 | 1301 |
| G7L.12aa0089.007.0177 | 1181 | 1302 |
| G7L.12aa0089.0180 | 1181 | 1303 |
| G7L.12aa0019.0180 | 1181 | 1304 |
| G7L.12aa0020.0180 | 1181 | 1305 |
| G7L.12aa0069.0180 | 1181 | 1306 |
| G7L.12aa0071.0180 | 1181 | 1307 |
| G7L.12aa0087.0180 | 1181 | 1308 |
| G7L.12aa0090.0180 | 1181 | 1309 |
| G7L.12aa0120.0180 | 1181 | 1310 |
| G7L.12aa0157.0180 | 1181 | 1311 |
| G7L.12aa0089.001.0180 | 1181 | 1312 |
| G7L.12aa0089.005.0180 | 1181 | 1313 |
| G7L.12aa0089.006.0180 | 1181 | 1314 |
| G7L.12aa0089.007.0180 | 1181 | 1315 |
| G7L.12aa0089.0181 | 1181 | 1316 |
| G7L.12aa0019.0181 | 1181 | 1317 |
| G7L.12aa0020.0181 | 1181 | 1318 |
| G7L.12aa0069.0181 | 1181 | 1319 |
| G7L.12aa0071.0181 | 1181 | 1320 |
| G7L.12aa0087.0181 | 1181 | 1321 |
| G7L.12aa0090.0181 | 1181 | 1322 |
| G7L.12aa0120.0181 | 1181 | 1323 |
| G7L.12aa0157.0181 | 1181 | 1324 |
| G7L.12aa0089.001.0181 | 1181 | 1325 |
| G7L.12aa0089.005.0181 | 1181 | 1326 |
| G7L.12aa0089.006.0181 | 1181 | 1327 |
| G7L.12aa0089.007.0181 | 1181 | 1328 |
| G7L.12aa0089.0182 | 1181 | 1329 |
| G7L.12aa0019.0182 | 1181 | 1330 |
| G7L.12aa0020.0182 | 1181 | 1331 |
| G7L.12aa0069.0182 | 1181 | 1332 |
| G7L.12aa0071.0182 | 1181 | 1333 |
| G7L.12aa0087.0182 | 1181 | 1334 |
| G7L.12aa0090.0182 | 1181 | 1335 |
| G7L.12aa0120.0182 | 1181 | 1336 |
| G7L.12aa0157.0182 | 1181 | 1337 |
| G7L.12aa0089.001.0182 | 1181 | 1338 |
| G7L.12aa0089.005.0182 | 1181 | 1339 |
| G7L.12aa0089.006.0182 | 1181 | 1340 |
| G7L.12aa0089.007.0182 | 1181 | 1341 |
| G7L.12aa0089.0185 | 1181 | 1342 |
| G7L.12aa0019.0185 | 1181 | 1343 |
| G7L.12aa0020.0185 | 1181 | 1344 |
| G7L.12aa0069.0185 | 1181 | 1345 |
| G7L.12aa0071.0185 | 1181 | 1346 |
| G7L.12aa0087.0185 | 1181 | 1347 |
| G7L.12aa0090.0185 | 1181 | 1348 |
| G7L.12aa0120.0185 | 1181 | 1349 |
| G7L.12aa0157.0185 | 1181 | 1350 |
| G7L.12aa0089.001.0185 | 1181 | 1351 |
| G7L.12aa0089.005.0185 | 1181 | 1352 |
| G7L.12aa0089.006.0185 | 1181 | 1353 |
| G7L.12aa0089.007.0185 | 1181 | 1354 |
| G7L.12aa0089.0200 | 1181 | 1355 |
| G7L.12aa0019.0200 | 1181 | 1356 |
| G7L.12aa0020.0200 | 1181 | 1357 |
| G7L.12aa0069.0200 | 1181 | 1358 |
| G7L.12aa0071.0200 | 1181 | 1359 |
| G7L.12aa0087.0200 | 1181 | 1360 |
| G7L.12aa0090.0200 | 1181 | 1361 |
| G7L.12aa0120.0200 | 1181 | 1362 |
| G7L.12aa0157.0200 | 1181 | 1363 |
| G7L.12aa0089.001.0200 | 1181 | 1364 |
| G7L.12aa0089.005.0200 | 1181 | 1365 |
| G7L.12aa0089.006.0200 | 1181 | 1366 |
| G7L.12aa0089.007.0200 | 1181 | 1367 |
| G7L.12aa0089.0203 | 1181 | 1368 |
| G7L.12aa0019.0203 | 1181 | 1369 |
| G7L.12aa0020.0203 | 1181 | 1370 |
| G7L.12aa0069.0203 | 1181 | 1371 |
| G7L.12aa0071.0203 | 1181 | 1372 |
| G7L.12aa0087.0203 | 1181 | 1373 |

TABLE 23-continued

MabCXCL10_G7 Variants

| Antibody variant name | Heavy chain SEQ ID NO | Light chain SEQ ID NO |
|---|---|---|
| G7L.12aa0090.0203 | 1181 | 1374 |
| G7L.12aa0120.0203 | 1181 | 1375 |
| G7L.12aa0157.0203 | 1181 | 1376 |
| G7L.12aa0089.001.0203 | 1181 | 1377 |
| G7L.12aa0089.005.0203 | 1181 | 1378 |
| G7L.12aa0089.006.0203 | 1181 | 1379 |
| G7L.12aa0089.007.0203 | 1181 | 1380 |

17-2. Evaluation of Protease Cleavage of Antibody Variants with an Introduced Protease Cleavage Sequence The antibody variants prepared in 17-1 were tested to see whether they would be cleaved by protease treatment. Recombinant human u-Plasminogen Activator/Urokinase (human uPA, huPA) (R&D Systems; 1310-SE-010) or recombinant human Matriptase/ST14 Catalytic Domain (human MT-SP1, hMT-SP1) (R&D Systems; 3946-SE-010) was used as the protease. The antibody variants were allowed to react for one hour under the conditions of 40 nM huPA or 3 nM hMT-SP1, 100 μg/mL antibody variant, PBS, and 37° C., and then subjected to capillary electrophoresis immunoassay. Wes (Protein Simple) was used for capillary electrophoresis immunoassay, and an anti-human lambda chain HRP-labeled antibody (abcam; ab9007) was used to detect light chains before and after cleavage. As a result, a peak of approximately 36 kDa that had been found prior to protease treatment disappeared, and a new peak appeared at approximately 20 kDa. This suggests that the peak of approximately 36 kDa was the uncleaved light chain of the antibody variant, and the peak of approximately 20 kDa was the cleaved light chain. The area of each peak obtained after protease treatment was output using software provided for Wes (Compass for SW; Protein Simple), and the cleavage ratio (%) of the antibody variant was determined with the following formula:

(Peak area of cleaved light chain)×100/(Peak area of cleaved light chain+Peak area of uncleaved light chain)

The cleavage ratios (%) of the antibody variants treated with huPA are shown in Table 24, and the cleavage ratios of the antibody variants treated with hMT-SP1 are shown in Table 25. Of the antibody variants shown in Tables 24 and 25 mentioned above, those with a higher cleavage ratio with huPA but a lower cleavage ratio with hMT-SP1, in other words, higher selectivity towards huPA, than G7L.106a.12aa (heavy chain: G7H-G1T4 (SEQ ID NO: 1181), light chain: G7L.106a.12aa-LT0 (SEQ ID NO: 1282)), are shown in Table 26.

TABLE 24

| Cleavage Ratios of Variants (huPA) | |
|---|---|
| Antibody variant name | Cleavage ratio (%) |
| G7L.106a.12aa | 86.82 |
| G7L.12aa.0177 | 85.50 |

TABLE 24-continued

| Cleavage Ratios of Variants (huPA) | |
|---|---|
| Antibody variant name | Cleavage ratio (%) |
| G7L.12aa.0180 | 85.66 |
| G7L.12aa.0181 | 84.87 |
| G7L.12aa.0182 | 83.98 |
| G7L.12aa.0185 | 82.91 |
| G7L.12aa0163 | 88.58 |
| G7L.12aa0166 | 88.12 |
| G7L.12aa0089.0177 | 79.35 |
| G7L.12aa0019.0177 | 91.10 |
| G7L.12aa0020.0177 | 88.82 |
| G7L.12aa0069.0177 | 88.84 |
| G7L.12aa0071.0177 | 71.65 |
| G7L.12aa0087.0177 | 88.64 |
| G7L.12aa0090.0177 | 82.65 |
| G7L.12aa0120.0177 | 90.00 |
| G7L.12aa0157.0177 | 77.63 |
| G7L.12aa0089.001.0177 | 79.68 |
| G7L.12aa0089.005.0177 | 91.36 |
| G7L.12aa0089.006.0177 | 88.39 |
| G7L.12aa0089.007.0177 | 86.52 |
| G7L.12aa0089.0180 | 82.10 |
| G7L.12aa0019.0180 | 82.83 |
| G7L.12aa0020.0180 | 89.09 |
| G7L.12aa0069.0180 | 85.85 |
| G7L.12aa0071.0180 | 85.87 |
| G7L.12aa0087.0180 | 87.87 |
| G7L.12aa0090.0180 | 87.52 |
| G7L.12aa0120.0180 | 83.14 |
| G7L.12aa0157.0180 | 87.37 |
| G7L.12aa0089.001.0180 | 78.29 |
| G7L.12aa0089.005.0180 | 85.47 |
| G7L.12aa0089.006.0180 | 87.50 |
| G7L.12aa0089.007.0180 | 90.07 |
| G7L.12aa0089.0181 | 82.88 |
| G7L.12aa0019.0181 | 89.53 |
| G7L.12aa0020.0181 | 88.63 |
| G7L.12aa0069.0181 | 84.37 |
| G7L.12aa0071.0181 | 87.39 |

TABLE 24-continued

Cleavage Ratios of Variants (huPA)

| Antibody variant name | Cleavage ratio (%) |
|---|---|
| G7L.12aa0087.0181 | 88.12 |
| G7L.12aa0090.0181 | 78.62 |
| G7L.12aa0120.0181 | 77.98 |
| G7L.12aa0157.0181 | 79.61 |
| G7L.12aa0089.001.0181 | 89.18 |
| G7L.12aa0089.005.0181 | 90.12 |
| G7L.12aa0089.006.0181 | 89.92 |
| G7L.12aa0089.007.0181 | 91.27 |
| G7L.12aa0089.0182 | no data |
| G7L.12aa0019.0182 | 87.05 |
| G7L.12aa0020.0182 | 90.72 |
| G7L.12aa0069.0182 | 89.73 |
| G7L.12aa0071.0182 | 82.75 |
| G7L.12aa0087.0182 | 85.02 |
| G7L.12aa0090.0182 | 81.94 |
| G7L.12aa0120.0182 | 80.22 |
| G7L.12aa0157.0182 | 78.22 |
| G7L.12aa0089.001.0182 | 83.32 |
| G7L.12aa0089.005.0182 | 84.25 |
| G7L.12aa0089.006.0182 | 86.29 |
| G7L.12aa0089.007.0182 | 90.06 |
| G7L.12aa0089.0185 | 78.36 |
| G7L.12aa0019.0185 | no data |
| G7L.12aa0020.0185 | no data |
| G7L.12aa0069.0185 | 75.99 |
| G7L.12aa0071.0185 | 82.77 |
| G7L.12aa0087.0185 | 72.78 |
| G7L.12aa0090.0185 | 82.67 |
| G7L.12aa0120.0185 | no data |
| G7L.12aa0157.0185 | 65.10 |
| G7L.12aa0089.001.0185 | 84.78 |
| G7L.12aa0089.005.0185 | 89.84 |
| G7L.12aa0089.006.0185 | 88.54 |
| G7L.12aa0089.007.0185 | 84.01 |
| G7L.12aa0089.0200 | 85.19 |
| G7L.12aa0019.0200 | 89.15 |
| G7L.12aa0020.0200 | 62.65 |
| G7L.12aa0069.0200 | 63.60 |
| G7L.12aa0071.0200 | 65.05 |
| G7L.12aa0087.0200 | 78.18 |
| G7L.12aa0090.0200 | 76.34 |
| G7L.12aa0120.0200 | 55.63 |
| G7L.12aa0157.0200 | 51.04 |
| G7L.12aa0089.001.0200 | 86.49 |
| G7L.12aa0089.005.0200 | 36.47 |
| G7L.12aa0089.006.0200 | 47.77 |
| G7L.12aa0089.007.0200 | 20.50 |
| G7L.12aa0089.0203 | 25.62 |
| G7L.12aa0019.0203 | 26.52 |
| G7L.12aa0020.0203 | 17.24 |
| G7L.12aa0069.0203 | 28.03 |
| G7L.12aa0071.0203 | 9.75 |
| G7L.12aa0087.0203 | 78.63 |
| G7L.12aa0090.0203 | 71.98 |
| G7L.12aa0120.0203 | 55.44 |
| G7L.12aa0157.0203 | 40.79 |
| G7L.12aa0089.001.0203 | 60.70 |
| G7L.12aa0089.005.0203 | 67.48 |
| G7L.12aa0089.006.0203 | 60.67 |
| G7L.12aa0089.007.0203 | 71.65 |

TABLE 25

Cleavage Ratios of Variants (hMT-SP1)

| Antibody variant name | Cleavage ratio (%) |
|---|---|
| G7L.106a.12aa | 65.07 |
| G7L.12aa.0177 | 21.86 |
| G7L.12aa.0180 | 28.97 |
| G7L.12aa.0181 | 21.72 |
| G7L.12aa.0182 | 28.23 |
| G7L.12aa.0185 | 26.51 |
| G7L.12aa0163 | 25.57 |
| G7L.12aa0166 | 25.26 |
| G7L.12aa0089.0177 | 32.38 |
| G7L.12aa0019.0177 | 28.38 |

TABLE 25-continued

Cleavage Ratios of Variants (hMT-SP1)

| Antibody variant name | Cleavage ratio (%) |
|---|---|
| G7L.12aa0020.0177 | 28.29 |
| G7L.12aa0069.0177 | 29.21 |
| G7L.12aa0071.0177 | 34.08 |
| G7L.12aa0087.0177 | 23.11 |
| G7L.12aa0090.0177 | 29.23 |
| G7L.12aa0120.0177 | 46.73 |
| G7L.12aa0157.0177 | 20.36 |
| G7L.12aa0089.001.0177 | 25.70 |
| G7L.12aa0089.005.0177 | 24.04 |
| G7L.12aa0089.006.0177 | 22.70 |
| G7L.12aa0089.007.0177 | 36.20 |
| G7L.12aa0089.0180 | 45.07 |
| G7L.12aa0019.0180 | 32.04 |
| G7L.12aa0020.0180 | 41.31 |
| G7L.12aa0069.0180 | 40.60 |
| G7L.12aa0071.0180 | 45.66 |
| G7L.12aa0087.0180 | 25.55 |
| G7L.12aa0090.0180 | 35.34 |
| G7L.12aa0120.0180 | 53.56 |
| G7L.12aa0157.0180 | 22.47 |
| G7L.12aa0089.001.0180 | 39.90 |
| G7L.12aa0089.005.0180 | 33.85 |
| G7L.12aa0089.006.0180 | 30.45 |
| G7L.12aa0089.007.0180 | 37.62 |
| G7L.12aa0089.0181 | 26.58 |
| G7L.12aa0019.0181 | 22.14 |
| G7L.12aa0020.0181 | 32.03 |
| G7L.12aa0069.0181 | 32.43 |
| G7L.12aa0071.0181 | 32.62 |
| G7L.12aa0087.0181 | 21.48 |
| G7L.12aa0090.0181 | 16.56 |
| G7L.12aa0120.0181 | 39.48 |
| G7L.12aa0157.0181 | 19.49 |
| G7L.12aa0089.001.0181 | 24.62 |
| G7L.12aa0089.005.0181 | 25.49 |
| G7L.12aa0089.006.0181 | 23.08 |
| G7L.12aa0089.007.0181 | 31.00 |
| G7L.12aa0089.0182 | no data |
| G7L.12aa0019.0182 | 22.43 |
| G7L.12aa0020.0182 | 26.16 |
| G7L.12aa0069.0182 | 29.41 |
| G7L.12aa0071.0182 | 25.14 |
| G7L.12aa0087.0182 | 19.97 |
| G7L.12aa0090.0182 | 29.72 |
| G7L.12aa0120.0182 | 36.65 |
| G7L.12aa0157.0182 | 19.55 |
| G7L.12aa0089.001.0182 | 26.63 |
| G7L.12aa0089.005.0182 | 23.62 |
| G7L.12aa0089.006.0182 | 21.62 |
| G7L.12aa0089.007.0182 | 19.79 |
| G7L.12aa0089.0185 | 25.62 |
| G7L.12aa0019.0185 | no data |
| G7L.12aa0020.0185 | no data |
| G7L.12aa0069.0185 | 24.64 |
| G7L.12aa0071.0185 | 27.25 |
| G7L.12aa0087.0185 | 17.84 |
| G7L.12aa0090.0185 | 27.39 |
| G7L.12aa0120.0185 | no data |
| G7L.12aa0157.0185 | 12.68 |
| G7L.12aa0089.001.0185 | 17.98 |
| G7L.12aa0089.005.0185 | 14.92 |
| G7L.12aa0089.006.0185 | 15.74 |
| G7L.12aa0089.007.0185 | 21.98 |
| G7L.12aa0089.0200 | 26.28 |
| G7L.12aa0019.0200 | 9.02 |
| G7L.12aa0020.0200 | 12.71 |
| G7L.12aa0069.0200 | 14.34 |
| G7L.12aa0071.0200 | 15.10 |
| G7L.12aa0087.0200 | 14.19 |
| G7L.12aa0090.0200 | 21.19 |
| G7L.12aa0120.0200 | 23.78 |
| G7L.12aa0157.0200 | 8.25 |
| G7L.12aa0089.001.0200 | 21.45 |
| G7L.12aa0089.005.0200 | 16.97 |
| G7L.12aa0089.006.0200 | 12.93 |

TABLE 25-continued

Cleavage Ratios of Variants (hMT-SP1)

| Antibody variant name | Cleavage ratio (%) |
|---|---|
| G7L.12aa0089.007.0200 | 17.33 |
| G7L.12aa0089.0203 | 10.82 |
| G7L.12aa0019.0203 | 0.21 |
| G7L.12aa0020.0203 | 6.37 |
| G7L.12aa0069.0203 | 11.43 |
| G7L.12aa0071.0203 | 0.61 |
| G7L.12aa0087.0203 | 11.18 |
| G7L.12aa0090.0203 | 8.63 |
| G7L.12aa0120.0203 | 22.68 |
| G7L.12aa0157.0203 | 7.00 |
| G7L.12aa0089.001.0203 | 16.46 |
| G7L.12aa0089.005.0203 | 14.89 |
| G7L.12aa0089.006.0203 | 13.98 |
| G7L.12aa0089.007.0203 | 19.83 |

TABLE 26

Antibody Variants

| Antibody variant name | Heavy chain SEQ ID NO | Light chain SEQ ID NO |
|---|---|---|
| G7L.12aa0163 | 1181 | 1288 |
| G7L.12aa0166 | 1181 | 1289 |
| G7L.12aa0019.0177 | 1181 | 1291 |
| G7L.12aa0020.0177 | 1181 | 1292 |
| G7L.12aa0069.0177 | 1181 | 1293 |
| G7L.12aa0087.0177 | 1181 | 1295 |
| G7L.12aa0120.0177 | 1181 | 1297 |
| G7L.12aa0089.005.0177 | 1181 | 1300 |
| G7L.12aa0089.006.0177 | 1181 | 1301 |
| G7L.12aa0020.0180 | 1181 | 1305 |
| G7L.12aa0087.0180 | 1181 | 1308 |
| G7L.12aa0090.0180 | 1181 | 1309 |
| G7L.12aa0157.0180 | 1181 | 1311 |
| G7L.12aa0089.006.0180 | 1181 | 1314 |
| G7L.12aa0089.007.0180 | 1181 | 1315 |
| G7L.12aa0019.0181 | 1181 | 1317 |
| G7L.12aa0020.0181 | 1181 | 1318 |
| G7L.12aa0071.0181 | 1181 | 1320 |
| G7L.12aa0087.0181 | 1181 | 1321 |
| G7L.12aa0089.001.0181 | 1181 | 1325 |
| G7L.12aa0089.005.0181 | 1181 | 1326 |
| G7L.12aa0089.006.0181 | 1181 | 1327 |
| G7L.12aa0089.007.0181 | 1181 | 1328 |
| G7L.12aa0019.0182 | 1181 | 1330 |
| G7L.12aa0020.0182 | 1181 | 1331 |
| G7L.12aa0069.0182 | 1181 | 1332 |
| G7L.12aa0089.007.0182 | 1181 | 1341 |
| G7L.12aa0089.005.0185 | 1181 | 1352 |
| G7L.12aa0089.006.0185 | 1181 | 1353 |

Example 18 In Vivo Cleavage Evaluation of Antibodies Produced by Introducing Various Protease Cleavage Sequences into an Anti-Human CXCL10 Neutralizing Antibody 18-1. Production of Bispecific Antibodies with an Introduced Protease Cleavage Sequence The protease cleavage sequences shown in Table 27 were introduced near the boundary between the light chain variable region and constant region of MabCXCL10_G7p (heavy chain: G7H-F760mnP17 (SEQ ID NO: 1381), light chain: G7L-LT0 (SEQ ID NO: 1182)), an antibody neutralizing human CXCL10, to produce MabCXCL10_G7p light chain variants with different protease cleavage sequences (Table 28).

The light chain of MabCXCL10_G7p and the protease cleavage sequence-containing light chain variants produced above were combined with the heavy chain, and MabCXCL10_G7p and the MabCXCL10_G7p variants shown in Table 29 were transiently expressed using Expi293™ cells (Life technologies) according to a method known to those skilled in the art, and purified using Protein A according to a method known to those skilled in the art.

In addition, an antibody against keyhole limpet hemocyanin, MabKLHn (heavy chain: IC17HdK-F760mnN17 (SEQ ID NO: 1390), light chain: IC17L-k0 (SEQ ID NO: 1391)), was also transiently expressed using Expi293™ cells (Life technologies) according to a method known to those skilled in the art, and purified using Protein A according to a method known to those skilled in the art.

The above-described MabCXCL10_G7p variants and MabKLHn were combined, and the bispecific antibodies against human CXCL10 and KLH shown in Table 30 were produced by the method described in WO2015/046467.

TABLE 27

Protease Cleavage Sequences

| SEQ ID NO | Cleavage sequence |
|---|---|
| 1382 | TSYTGRSAVPRG |
| 1383 | TSYSGRSAVVRG |
| 1384 | TSYTGRSAVYRG |
| 1385 | TSYTGRSAVHRG |

TABLE 28

MabCXCL10_G7p Light Chain Variants

| SEQ ID NO | Variant light chain name |
|---|---|
| 1386 | G7L.12aa0089.001-LT0 |
| 1387 | G7L.12aa0089.003-LT0 |
| 1388 | G7L.12aa0089.005-LT0 |
| 1389 | G7L.12aa0089.007-LT0 |

TABLE 29

MabCXCL10_G7p Variants

| Antibody variant name | Heavy chain SEQ ID NO | Light chain SEQ ID NO |
|---|---|---|
| G7 | 1381 | 1182 |
| G7L.12aa0089.001 | 1381 | 1386 |
| G7L.12aa0089.003 | 1381 | 1387 |
| G7L.12aa0089.005 | 1381 | 1388 |
| G7L.12aa0089.007 | 1381 | 1389 |

TABLE 30

Bispecific Antibodies of MabCXCL10_G7p Variants and MabKLHn

| Antibody variant name | Anti-CXCL10 variant antibody | | Anti-KLH antibody | |
|---|---|---|---|---|
| | Heavy chain SEQ ID NO | Light chain SEQ ID NO | Heavy chain SEQ ID NO | Light chain SEQ ID NO |
| G7//KLH | 1381 | 1182 | 1390 | 1391 |
| G7L.12aa0089.001//KLH | 1381 | 1386 | 1300 | 1391 |
| G7L.12aa0089.003//KLH | 1381 | 1387 | 1390 | 1391 |
| G7L.12aa0089.005//KLH | 1381 | 1388 | 1390 | 1391 |
| G7L.12aa0089.007//KLH | 1381 | 1389 | 1390 | 1391 |

18-2. Production of a Cell Line Stably Expressing Protease

B16F10/chGPC3/muPA was used as a protease stable expression cell line to be transplanted into mice. This cell line was produced by introducing a modified mouse chimeric Glypican 3 (chGPC3) gene and a mouse uPA (muPA: NM_008873) gene into a mouse melanoma cell line, B16F10, and establishing and then cloning a stably expressing cell line. B16F10/chGPC3/muPA cells were cultured in RPMI1640 medium (Nacalai Tesque) containing 10% FBS (SIGMA), 0.5 mg/mL Geneticin (Gibco), and 1.5 μg/mL Puromycin (Gibco).

18-3. Production of a Syngeneic Tumor Line-Transplanted Mouse Model

The animals used for transplant were C57BL/6NCrl mice (six weeks old, female) purchased from Charles River Laboratories. B16F10/chGPC3/muPA cells were transplanted subcutaneously into C57BL/6NCrl mice (1E6 cells per animal). When the average volume of the transplanted tumor reached about 200 mm3 to 300 mm3, the mice were used as model mice to which a variant antibody was administered.

The volume of the tumor graft was calculated with the following formula:

Tumor volume=long diameter×short diameter×short diameter/2

18-4. Preparation of Agents to be Administered

The antibody variants produced in Example 18-1, into which the protease cleavage sequences shown in Table 29 were introduced, were used as agents to be administered to the B16F10/chGPC3/muPA cell-transplanted model mice. The agents to be administered were prepared using PBST-buffer (PBS+0.05% Tween®20 buffer) such that the concentration of the variant antibody was 0.1 mg/mL.

18-5. Administration Test of Antibody Variants in Order to Evaluate Protease Cleavage After 11 days of transplant, the B16F10/chGPC3/muPA cell-transplanted mice were given five antibody variant samples with different introduced protease cleavage sequences via the tail vein at a dose of 1 mg/kg (mg administered antibody per kg mouse body weight). The names of antibody variants, doses, administration methods, and other details in the administration test are shown in Table 31.

TABLE 31

Summary of Administration Test in Mice

| Group | Number of mice | Agent | Dose | Administration method | Day of administration |
|---|---|---|---|---|---|
| 1 | 3 | G7//KLH | 1 mg/kg | Tail vein | Day 11 aller transplant |
| 2 | 3 | G7L.12aa0089.001//KLH | 1 mg/kg | Tail vein | Day 11 after transplant |
| 3 | 3 | G7L.12aa0089.003//KLH | 1 mg/kg | Tail vein | Day 11 after transplant |
| 4 | 3 | G7L.12aa0089.005//KLH | 1 mg/kg | Tail vein | Day 11 after transplant |
| 5 | 3 | G7L.12aa0089.007//KLH | 1 mg/kg | Tail vein | Day 11 alter transplant |

18-6. Orbital Blood Collection from B16F10/chGPC3/muPA Cell-Transplanted Model Mice On days 1 and 3 after administration of the antibody variant, blood was collected from the eye socket of the B16F10/chGPC3/muPA cell-transplanted model mice. The blood collection was carried out under isoflurane anesthesia. Collected blood was centrifuged at 1,900×g, 4° C. for ten minutes. After the centrifugation, the supernatant was obtained as plasma components and stored at −30° C.

18-7. Evaluation of Cleavage of Administered Antibodies Collected from Mice

Figure 32:
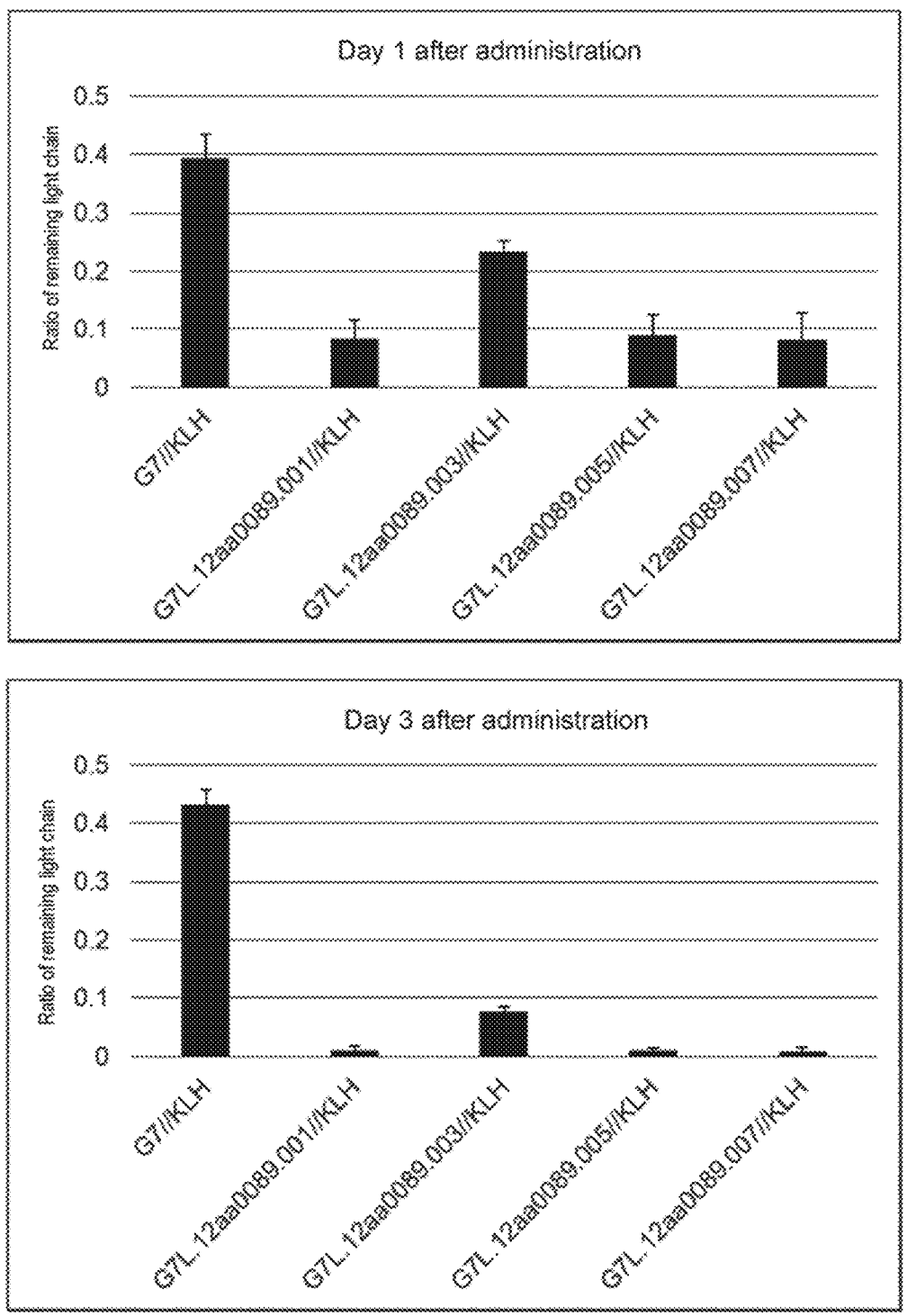

Antibodies were purified from the plasma collected in Example 18-6 using Dynabeads Protein A (Thermo; 10001D) by a method known to those skilled in the art, and subjected to capillary electrophoresis immunoassay in order to evaluate the efficiency of protease cleavage of the antibody variants. Wes (Protein Simple) was used for capillary electrophoresis immunoassay. To detect the antibody light chain, an anti-human lambda chain HRP-labeled antibody (abcam; ab9007) was used. To detect the antibody heavy chain, an anti-human heavy chain HRP-labeled antibody (Protein Simple; 043-491) was used. As a result, a peak of the uncleaved, full-length light chain was detected at approximately 36 kDa with the anti-human lambda chain antibody, and a peak of the full-length heavy chain was detected at approximately 56 kDa with the anti-human heavy chain antibody. The light chain of MabKLHn is a kappa chain, which is not detected with the anti-human lambda chain antibody. Therefore, the anti-human lambda chain antibody can be used to evaluate the cleavage efficiency of the protease cleavage sequence-introduced light chain. The area of each peak obtained by capillary electrophoresis immunoassay was output using software provided for Wes (Compass for SW; Protein Simple), and the ratio of the remaining light chain was calculated as [Peak area of light chain]/[Peak area of heavy chain] to determine the ratio of the full-length light chain that remained uncleaved in the mouse body. The ratios of the remaining light chain of the antibodies collected one day and three days after being administered to mice are shown in FIG. 32. As a result, the protease cleavage sequence-introduced variants of MabCXCL10_G7p were found to have a lower remaining light chain ratio than MabCXCL10_G7p in the body of the tumor-transplanted mice. That is, it was shown that the light chains into which a protease cleavage sequence was introduced were efficiently cleaved in vivo in the tumor-transplanted mice.

The invention mentioned above are described in detail with reference to actual examples and illustrated examples with the aim of helping clear understanding. However, the description and illustration in the present specification should not be interpreted as limiting the scope of the present invention. The disclosure of all patent literatures and scientific literatures cited herein is explicitly incorporated herein by reference in its entirety.

INDUSTRIAL APPLICABILITY

The ligand-binding molecule of the present invention in a state bound with the ligand can be transported in vivo and cleaved in a disease tissue, so that its binding to the ligand is attenuated to release the ligand specifically in the disease tissue. Therefore, the disease tissue can be specifically exposed to the ligand. Furthermore, the ligand-binding molecule suppresses the biological activity of the ligand during transport, and therefore decreases the risk of systemic action of the ligand, which makes the ligand-binding molecule very useful in the treatment of a disease.

SEQUENCE LISTING (1391 sequences)

SEQ ID NO: 1 - protein, 452 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 2 - protein, 216 aa, Artificial sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3 - protein, 8 aa, Artificial sequence
  an artificially synthesized sequence
LSGRSDNH

SEQ ID NO: 4 - protein, 460 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSLSGRSDNHASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 5 - protein, 460 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSASLSGRSDNHTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 6 - protein, 460 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVLSGRSDNHSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 7 - protein, 460 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSLSGRSDNHSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 8 - protein, 460 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSALSGRSDNHSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 9 - protein, 460 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSASTLSGRSDNHKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 10 - protein, 460 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSASTKLSGRSDNHGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 11 - protein, 460 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSASLSGRSDNHGKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 12 - protein, 460 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVLSGRSDNHGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 13 - protein, 460 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSLSGRSDNHGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 14 - protein, 460 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSALSGRSDNHGTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 15 - protein, 224 aa, Artificial sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIKLSGRSDNHRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16 - protein, 224 aa, Artificial sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIKRTLSGRSDNHVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17 - protein, 224 aa, Artificial sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDLSGRSDNHIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18 - protein, 224 aa, Artificial sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDILSGRSDNHKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19 - protein, 224 aa, Artificial sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIKRLSGRSDNHTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20 - protein, 224 aa, Artificial sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIKRTVLSGRSDNHAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21 - protein, 224 aa, Artificial sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIKRTVALSGRSDNHAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22 - protein, 224 aa, Artificial sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIKRLSGRSDNHGVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 23 - protein, 462 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVGLSGRSDNHGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 24 - protein, 464 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSGLSGRSDNHGSSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 25 - protein, 466 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVGSGLSGRSDNHGSSSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 26 - protein, 468 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVGGSGLSGRSDNHGSSGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 27 - protein, 470 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSGGSGLSGRSDNHGSSGTSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 28 - protein, 10 aa, Artificial sequence
  an artificially synthesized sequence
GLSGRSDNHG

SEQ ID NO: 29 - protein, 12 aa, Artificial sequence
  an artificially synthesized sequence
SGLSGRSDNHGS

SEQ ID NO: 30 - protein, 14 aa, Artificial sequence
  an artificially synthesized sequence
GSGLSGRSDNHGSS

SEQ ID NO: 31 - protein, 16 aa, Artificial sequence
  an artificially synthesized sequence
GGSGLSGRSDNHGSSG

SEQ ID NO: 32 - protein, 18 aa, Artificial sequence
  an artificially synthesized sequence
SGGSGLSGRSDNHGSSGT

SEQ ID NO: 33 - protein, 472 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSGGSGLSGRSDNHGSSGTSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - protein, 6 aa, Artificial sequence
  an artificially synthesized sequence
PLGLAG

SEQ ID NO: 35 - protein, 8 aa, Artificial sequence
  an artificially synthesized sequence
VPLSLTMG

SEQ ID NO: 36 - protein, 4 aa, Artificial sequence
  an artificially synthesized sequence
GGGS

SEQ ID NO: 37 - protein, 4 aa, Artificial sequence
  an artificially synthesized sequence
GGSG

SEQ ID NO: 38 - protein, 4 aa, Artificial sequence
  an artificially synthesized sequence
GSGG

SEQ ID NO: 39 - protein, 4 aa, Artificial sequence
  an artificially synthesized sequence
SGGG

SEQ ID NO: 40 - protein, 4 aa, Artificial sequence
  an artificially synthesized sequence
GSSG

SEQ ID NO: 41 - protein, 5 aa, Artificial sequence
  an artificially synthesized sequence
GGGGS

SEQ ID NO: 42 - protein, 5 aa, Artificial sequence
  an artificially synthesized sequence
GGGSG

SEQ ID NO: 43 - protein, 5 aa, Artificial sequence
  an artificially synthesized sequence
GGSGG

SEQ ID NO: 44 - protein, 5 aa, Artificial sequence
  an artificially synthesized sequence
GSGGG

SEQ ID NO: 45 - protein, 5 aa, Artificial sequence
  an artificially synthesized sequence
GSGGS

SEQ ID NO: 46 - protein, 5 aa, Artificial sequence
  an artificially synthesized sequence
SGGGG

SEQ ID NO: 47 - protein, 5 aa, Artificial sequence
  an artificially synthesized sequence
GSSGG

SEQ ID NO: 48 - protein, 5 aa, Artificial sequence
  an artificially synthesized sequence
GSGSG

SEQ ID NO: 49 - protein, 5 aa, Artificial sequence
  an artificially synthesized sequence
SGGSG

SEQ ID NO: 50 - protein, 5 aa, Artificial sequence
  an artificially synthesized sequence
GSSSG

SEQ ID NO: 51 - protein, 6 aa, Artificial sequence
  an artificially synthesized sequence
GGGGGS

SEQ ID NO: 52 - protein, 6 aa, Artificial sequence
  an artificially synthesized sequence
SGGGGG

SEQ ID NO: 53 - protein, 7 aa, Artificial sequence
  an artificially synthesized sequence
GGGGGGS

SEQ ID NO: 54 - protein, 7 aa, Artificial sequence
  an artificially synthesized sequence
SGGGGGG

SEQ ID NO: 55 - protein, 330 aa, Homo sapiens [sequence omitted]

SEQ ID NO: 56 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 57 - protein, 377 aa, Homo sapiens
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 58 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 59 - protein, 462 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSGLSGRSDNHGSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 60 - protein, 468 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSGGSGLSGRSDNHGSSGTSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 61 - protein, 11 aa, Artificial sequence
  an artificially synthesized sequence
GLSGRSDNHGS

SEQ ID NO: 62 - protein, 20 aa, Artificial sequence
  an artificially synthesized sequence
TVSSGLSGRSDNHGSSTKGP

SEQ ID NO: 63 - protein, 17 aa, Artificial sequence
  an artificially synthesized sequence
GGSGLSGRSDNHGSSGT

SEQ ID NO: 64 - protein, 26 aa, Artificial sequence
  an artificially synthesized sequence
TVSSGGSGLSGRSDNHGSSGTSTKGP

SEQ ID NO: 65 - protein, 454 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 12 aa, Artificial sequence
  an artificially synthesized sequence
TSTSGRSANPRG

SEQ ID NO: 67 - protein, 13 aa, Artificial sequence
  an artificially synthesized sequence
ISSGLLSGRSDNH

SEQ ID NO: 68 - protein, 18 aa, Artificial sequence
  an artificially synthesized sequence
AVGLLAPPGGLSGRSDNH

SEQ ID NO: 69 - protein, 13 aa, Artificial sequence
  an artificially synthesized sequence
GAGVPMSMRGGAG

SEQ ID NO: 70 - protein, 13 aa, Artificial sequence
  an artificially synthesized sequence
GAGIPVSLRSGAG

SEQ ID NO: 71 - protein, 8 aa, Artificial sequence
  an artificially synthesized sequence
GPLGIAGQ

SEQ ID NO: 72 - protein, 10 aa, Artificial sequence
  an artificially synthesized sequence
GGPLGMLSQS

SEQ ID NO: 73 - protein, 6 aa, Artificial sequence
  an artificially synthesized sequence
PLGLWA

SEQ ID NO: 74 - protein, 13 aa, Artificial sequence
  an artificially synthesized sequence
GAGRPFSMIMGAG

SEQ ID NO: 75 - protein, 13 aa, Artificial sequence
  an artificially synthesized sequence
GAGVPLSLTMGAG

SEQ ID NO: 76 - protein, 13 aa, Artificial sequence
  an artificially synthesized sequence
GAGVPLSLYSGAG

SEQ ID NO: 77 - protein, 6 aa, Artificial sequence
  an artificially synthesized sequence
AANLRN

SEQ ID NO: 78 - protein, 6 aa, Artificial sequence
  an artificially synthesized sequence
AQAYVK

SEQ ID NO: 79 - protein, 6 aa, Artificial sequence
  an artificially synthesized sequence
AANYMR

SEQ ID NO: 80 - protein, 6 aa, Artificial sequence
  an artificially synthesized sequence
AAALTR

SEQ ID NO: 81 - protein, 6 aa, Artificial sequence
  an artificially synthesized sequence
AQNLMR

SEQ ID NO: 82 - protein, 6 aa, Artificial sequence
  an artificially synthesized sequence
AANYTK

SEQ ID NO: 83 - protein, 16 aa, Artificial sequence
  an artificially synthesized sequence
GAGPQGLAGQRGIVAG

SEQ ID NO: 84 - protein, 8 aa, Artificial sequence
  an artificially synthesized sequence
PRFKIIGG

SEQ ID NO: 85 - protein, 8 aa, Artificial sequence
  an artificially synthesized sequence
PRFRIIGG

SEQ ID NO: 86 - protein, 9 aa, Artificial sequence
  an artificially synthesized sequence
GAGSGRSAG

SEQ ID NO: 87 - protein, 5 aa, Artificial sequence
  an artificially synthesized sequence
SGRSA

SEQ ID NO: 88 - protein, 6 aa, Artificial sequence
  an artificially synthesized sequence
GSGRSA

SEQ ID NO: 89 - protein, 5 aa, Artificial sequence
  an artificially synthesized sequence
SGKSA

SEQ ID NO: 90 - protein, 5 aa, Artificial sequence
  an artificially synthesized sequence
SGRSS

SEQ ID NO: 91 - protein, 5 aa, Artificial sequence
  an artificially synthesized sequence
SGRRA

SEQ ID NO: 92 - protein, 5 aa, Artificial sequence
  an artificially synthesized sequence
SGRNA

SEQ ID NO: 93 - protein, 5 aa, Artificial sequence
  an artificially synthesized sequence
SGRKA

SEQ ID NO: 94 - protein, 6 aa, Artificial sequence
  an artificially synthesized sequence
QRGRSA

SEQ ID NO: 95 - protein, 17 aa, Artificial sequence
  an artificially synthesized sequence
GAGSLLKSRMVPNFNAG

SEQ ID NO: 96 - protein, 6 aa, Artificial sequence
  an artificially synthesized sequence
TQGAAA

SEQ ID NO: 97 - protein, 6 aa, Artificial sequence
  an artificially synthesized sequence
GAAAAA

SEQ ID NO: 98 - protein, 6 aa, Artificial sequence
  an artificially synthesized sequence
GAGAAG

SEQ ID NO: 99 - protein, 6 aa, Artificial sequence
  an artificially synthesized sequence
AAAAAG

SEQ ID NO: 100 - protein, 6 aa, Artificial sequence
  an artificially synthesized sequence
LCGAAI

SEQ ID NO: 101 - protein, 6 aa, Artificial sequence
  an artificially synthesized sequence
FAQALG

SEQ ID NO: 102 - protein, 6 aa, Artificial sequence
  an artificially synthesized sequence
LLQANP

SEQ ID NO: 103 - protein, 6 aa, Artificial sequence
  an artificially synthesized sequence
LAAANP

SEQ ID NO: 104 - protein, 6 aa, Artificial sequence
  an artificially synthesized sequence
LYGAQF

SEQ ID NO: 105 - protein, 6 aa, Artificial sequence
  an artificially synthesized sequence
LSQAQG

SEQ ID NO: 106 - protein, 6 aa, Artificial sequence
  an artificially synthesized sequence
ASAASG

SEQ ID NO: 107 - protein, 6 aa, Artificial sequence
  an artificially synthesized sequence
FLGASL

SEQ ID NO: 108 - protein, 6 aa, Artificial sequence
  an artificially synthesized sequence
AYGATG

SEQ ID NO: 109 - protein, 6 aa, Artificial sequence
  an artificially synthesized sequence
LAQATG

SEQ ID NO: 110 - protein, 17 aa, Artificial sequence
  an artificially synthesized sequence
GAGSGVVIATVIVITAG

SEQ ID NO: 111 - protein, 8 aa, Artificial sequence
  an artificially synthesized sequence
APMAEGGG

SEQ ID NO: 112 - protein, 8 aa, Artificial sequence
  an artificially synthesized sequence
EAQGDKII

SEQ ID NO: 113 - protein, 8 aa, Artificial sequence
  an artificially synthesized sequence
LAFSDAGP

SEQ ID NO: 114 - protein, 7 aa, Artificial sequence
  an artificially synthesized sequence
YVADAPK

SEQ ID NO: 115 - protein, 5 aa, Artificial sequence
  an artificially synthesized sequence
RRRRR

SEQ ID NO: 116 - protein, 6 aa, Artificial sequence
  an artificially synthesized sequence
RRRRRR

SEQ ID NO: 117 - protein, 10 aa, Artificial sequence
  an artificially synthesized sequence
GQSSRHRRAL

SEQ ID NO: 118 - protein, 9 aa, Artificial sequence
  an artificially synthesized sequence
SSRHRRALD

SEQ ID NO: 119 - protein, 14 aa, Artificial sequence
  an artificially synthesized sequence
RKSSIIIRMRDVVL

SEQ ID NO: 120 - protein, 15 aa, Artificial sequence
  an artificially synthesized sequence
SSSFDKGKYKKGDDA

SEQ ID NO: 121 - protein, 15 aa, Artificial sequence
  an artificially synthesized sequence
SSSFDKGKYKRGDDA

SEQ ID NO: 122 - protein, 4 aa, Artificial sequence
  an artificially synthesized sequence
IEGR

SEQ ID NO: 123 - protein, 4 aa, Artificial sequence
  an artificially synthesized sequence
IDGR

SEQ ID NO: 124 - protein, 7 aa, Artificial sequence
  an artificially synthesized sequence
GGSIDGR

SEQ ID NO: 125 - protein, 8 aa, Artificial sequence
  an artificially synthesized sequence
GPQGIAGQ

SEQ ID NO: 126 - protein, 8 aa, Artificial sequence
  an artificially synthesized sequence
GPQGLLGA

SEQ ID NO: 127 - protein, 5 aa, Artificial sequence
  an artificially synthesized sequence
GIAGQ

SEQ ID NO: 128 - protein, 7 aa, Artificial sequence
  an artificially synthesized sequence
GPLGIAG

SEQ ID NO: 129 - protein, 8 aa, Artificial sequence
  an artificially synthesized sequence
GPEGLRVG

SEQ ID NO: 130 - protein, 8 aa, Artificial sequence
  an artificially synthesized sequence
YGAGLGVV

SEQ ID NO: 131 - protein, 8 aa, Artificial sequence
  an artificially synthesized sequence
AGLGVVER

SEQ ID NO: 132 - protein, 8 aa, Artificial sequence
  an artificially synthesized sequence
AGLGISST

SEQ ID NO: 133 - protein, 8 aa, Artificial sequence
  an artificially synthesized sequence
EPQALAMS

SEQ ID NO: 134 - protein, 8 aa, Artificial sequence
  an artificially synthesized sequence
QALAMSAI

SEQ ID NO: 135 - protein, 8 aa, Artificial sequence
  an artificially synthesized sequence
AAYHLVSQ

SEQ ID NO: 136 - protein, 8 aa, Artificial sequence
  an artificially synthesized sequence
MDAFLESS

SEQ ID NO: 137 - protein, 8 aa, Artificial sequence
  an artificially synthesized sequence
ESLPVVAV

SEQ ID NO: 138 - protein, 8 aa, Artificial sequence
  an artificially synthesized sequence
SAPAVESE

SEQ ID NO: 139 - protein, 8 aa, Artificial sequence
  an artificially synthesized sequence
DVAQFVLT

SEQ ID NO: 140 - protein, 8 aa, Artificial sequence
  an artificially synthesized sequence
VAQFVLTE

SEQ ID NO: 141 - protein, 8 aa, Artificial sequence
  an artificially synthesized sequence
AQFVLTEG

SEQ ID NO: 142 - protein, 8 aa, Artificial sequence
  an artificially synthesized sequence
PVQPIGPQ

SEQ ID NO: 143 - protein, 6 aa, Artificial sequence
  an artificially synthesized sequence
LVPRGS

SEQ ID NO: 144 - protein, 447 aa, Artificial sequence
  an artificially synthesized sequence
EVQLVQSGAEVKKPGESLKISCKGSGYSFTTYWLGWVRQMPGKGLDWIGIMSPVDSDIRYSPSFQGQVTMSVDKSITTAYLQWNSLKASDTAMYYCARRRPGQGYFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 145 - protein, 214 aa, Artificial sequence
  an artificially synthesized sequence
DIQMTQSPSSLSASVGDRVTITCRASQGISSWLAWYQQKPEKAPKSLIYAASSLQSGVPSRFSGSGSGTDFTLTISSLQPEDFATYYCQQYNIYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 146 - protein, 461 aa, Artificial sequence
  an artificially synthesized sequence
EVQLVQSGAEVKKPGESLKISCKGSGYSFTTYWLGWVRQMPGKGLDWIGIMSPVDSDIRYSPSFQGQVTMSVDKSITTAYLQWNSLKASDTAMYYCARRRPGQGYFDFWGQGTLVTVSSASGSGLSGRSDNHGSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 147 - protein, 447 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 148 - protein, 214 aa, Artificial sequence [sequence omitted]

SEQ ID NO: 149 - protein, 16 aa, Artificial sequence
  an artificially synthesized sequence
GGGGSPLGLAGGGGGS

SEQ ID NO: 150 - protein, 18 aa, Artificial sequence
  an artificially synthesized sequence
GGGGSGPLGIAGQGGGGS

SEQ ID NO: 151 - protein, 16 aa, Artificial sequence
  an artificially synthesized sequence
GGGGSPLGLWAGGGGS

SEQ ID NO: 152 - protein, 23 aa, Artificial sequence
  an artificially synthesized sequence
GGGGSGAGVPLSLYSGAGGGGGS

SEQ ID NO: 153 - protein, 463 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGGGSPLGLAGGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 154 - protein, 465 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGGGSGPLGIAGQGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 155 - protein, 463 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGGGSPLGLWAGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 156 - protein, 470 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGGGSGAGVPLSLYSGAGGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 157 - protein, 460 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGAGIPVSLRSGAGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 158 - protein, 457 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGPLGMLSQSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 159 - protein, 460 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGAGVPLSLTMGAGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 160 - protein, 12 aa, Artificial sequence
  an artificially synthesized sequence
TSTSGRSANPRG

SEQ ID NO: 161 - protein, 119 aa, Artificial sequence [sequence omitted]

SEQ ID NO: 162 - protein, 328 aa, Artificial sequence
  an artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 163 - protein, 131 aa, Artificial sequence
  an artificially synthesized sequence
QVQLQESTSTSGRSANPRGGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 164 - protein, 131 aa, Artificial sequence
  an artificially synthesized sequence
QVQLQESGTSTSGRSANPRGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 165 - protein, 131 aa, Artificial sequence
  an artificially synthesized sequence
QVQLQESGPTSTSGRSANPRGGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 166 - protein, 131 aa, Artificial sequence
  an artificially synthesized sequence
QVQLQESGPGTSTSGRSANPRGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 167 - protein, 131 aa, Artificial sequence
  an artificially synthesized sequence
QVQLQESGPGLTSTSGRSANPRGVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 168 - protein, 131 aa, Artificial sequence
  an artificially synthesized sequence
QVQLQESGPGLVTSTSGRSANPRGRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 169 - protein, 131 aa, Artificial sequence
  an artificially synthesized sequence
QVQLQESGPGLVRTSTSGRSANPRGPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 170 - protein, 131 aa, Artificial sequence
  an artificially synthesized sequence
QVQLQESGPGLVRPTSTSGRSANPRGSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 171 - protein, 131 aa, Artificial sequence
  an artificially synthesized sequence
QVQLQESGPGLVRPSTSTSGRSANPRGQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 172 - protein, 131 aa, Artificial sequence
  an artificially synthesized sequence
QVQLQESGPGLVRPSQTLSLTCTVSGYSITSDHAWSWVRQPTSTSGRSANPRGPGRGLEWIGYISYSGITTYNPSLKSRVTMLRDTSKNQFSLRLSSVTAADTAVYYCARSLARTTAMDYWGQGSLVTVSS

SEQ ID NO: 173 - protein, 131 aa, Artificial sequence
  an artificially synthesized sequence
QVQLQESGPGLVRPSQTLSLTCTVSGYSITSDHAWSWVRQPPTSTSGRSANPRGGRGLEWIGYISYSGITTYNPSLKSRVTMLRDTSKNQFSLRLSSVTAADTAVYYCARSLARTTAMDYWGQGSLVTVSS

SEQ ID NO: 174 - protein, 131 aa, Artificial sequence
  an artificially synthesized sequence
QVQLQESGPGLVRPSQTLSLTCTVSGYSITSDHAWSWVRQPPGTSTSGRSANPRGRGLEWIGYISYSGITTYNPSLKSRVTMLRDTSKNQFSLRLSSVTAADTAVYYCARSLARTTAMDYWGQGSLVTVSS

SEQ ID NO: 175 - protein, 131 aa, Artificial sequence
  an artificially synthesized sequence
QVQLQESGPGLVRPSQTLSLTCTVSGYSITSDHAWSWVRQPPGRTSTSGRSANPRGGLEWIGYISYSGITTYNPSLKSRVTMLRDTSKNQFSLRLSSVTAADTAVYYCARSLARTTAMDYWGQGSLVTVSS

SEQ ID NO: 176 - protein, 131 aa, Artificial sequence
  an artificially synthesized sequence
QVQLQESGPGLVRPSQTLSLTCTVSGYSITSDHAWSWVRQPPGRGTSTSGRSANPRGLEWIGYISYSGITTYNPSLKSRVTMLRDTSKNQFSLRLSSVTAADTAVYYCARSLARTTAMDYWGQGSLVTVSS

SEQ ID NO: 177 - protein, 131 aa, Artificial sequence
  an artificially synthesized sequence
QVQLQESGPGLVRPSQTLSLTCTVSGYSITSDHAWSWVRQPPGRGLTSTSGRSANPRGEWIGYISYSGITTYNPSLKSRVTMLRDTSKNQFSLRLSSVTAADTAVYYCARSLARTTAMDYWGQGSLVTVSS

SEQ ID NO: 178 - protein, 131 aa, Artificial sequence
  an artificially synthesized sequence
QVQLQESGPGLVRPSQTLSLTCTVSGYSITSDHAWSWVRQPPGRGLEWIGYISYSGTSTSGRSANPRGITTYNPSLKSRVTMLRDTSKNQFSLRLSSVTAADTAVYYCARSLARTTAMDYWGQGSLVTVSS

SEQ ID NO: 179 - protein, 131 aa, Artificial sequence
  an artificially synthesized sequence
QVQLQESGPGLVRPSQTLSLTCTVSGYSITSDHAWSWVRQPPGRGLEWIGYISYSGITSTSGRSANPRGTTYNPSLKSRVTMLRDTSKNQFSLRLSSVTAADTAVYYCARSLARTTAMDYWGQGSLVTVSS

SEQ ID NO: 180 - protein, 131 aa, Artificial sequence
  an artificially synthesized sequence
QVQLQESGPGLVRPSQTLSLTCTVSGYSITSDHAWSWVRQPPGRGLEWIGYISYSGITTSTSGRSANPRGTYNPSLKSRVTMLRDTSKNQFSLRLSSVTAADTAVYYCARSLARTTAMDYWGQGSLVTVSS

SEQ ID NO: 181 - protein, 131 aa, Artificial sequence
  an artificially synthesized sequence
QVQLQESGPGLVRPSQTLSLTCTVSGYSITSDHAWSWVRQPPGRGLEWIGYISYSGITTTSTSGRSANPRGYNPSLKSRVTMLRDTSKNQFSLRLSSVTAADTAVYYCARSLARTTAMDYWGQGSLVTVSS

SEQ ID NO: 182 - protein, 131 aa, Artificial sequence
  an artificially synthesized sequence
QVQLQESGPGLVRPSQTLSLTCTVSGYSITSDHAWSWVRQPPGRGLEWIGYISYSGITTYTSTSGRSANPRGNPSLKSRVTMLRDTSKNQFSLRLSSVTAADTAVYYCARSLARTTAMDYWGQGSLVTVSS

SEQ ID NO: 183 - protein, 131 aa, Artificial sequence
  an artificially synthesized sequence
QVQLQESGPGLVRPSQTLSLTCTVSGYSITSDHAWSWVRQPPGRGLEWIGYISYSGITTYNTSTSGRSANPRGPSLKSRVTMLRDTSKNQFSLRLSSVTAADTAVYYCARSLARTTAMDYWGQGSLVTVSS

SEQ ID NO: 184 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPTSTSGRSANPRGSLKSRVTMLRDTSKNQFSLRLSSVTAADTAVYYCARSLARTTAMDYWGQGSLVTVSS

SEQ ID NO: 185 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSTSTSGRSANPRGLKSRVTMLRDTSKNQFSLRLSSVTAADTAVYYCARSLARTTAMDYWGQGSLVTVSS

SEQ ID NO: 186 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLTSTSGRSANPRGKSRVTMLRDTSKNQFSLRLSSVTAADTAVYYCARSLARTTAMDYWGQGSLVTVSS

SEQ ID NO: 187 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKTSTSGRSANPRGSRVTMLRDTSKNQFSLRLSSVTAADTAVYYCARSLARTTAMDYWGQGSLVTVSS

SEQ ID NO: 188 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSTSTSGRSANPRGRVTMLRDTSKNQFSLRLSSVTAADTAVYYCARSLARTTAMDYWGQGSLVTVSS

SEQ ID NO: 189 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRTSTSGRSANPRGVTMLRDTSKNQFSLRLSSVTAADTAVYYCARSLARTTAMDYWGQGSLVTVSS

SEQ ID NO: 190 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTSTSGRSANPRGTMLRDTSKNQFSLRLSSVTAADTAVYYCARSLARTTAMDYWGQGSLVTVSS

SEQ ID NO: 191 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTTSTSGRSANPRGMLRDTSKNQFSLRLSSVTAADTAVYYCARSLARTTAMDYWGQGSLVTVSS

SEQ ID NO: 192 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTTSTSGRSANPRGSKNQFSLRLSSVTAADTAVYYCARSLARTTAMDYWGQGSLVTVSS

SEQ ID NO: 193 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSTSTSGRSANPRGKNQFSLRLSSVTAADTAVYYCARSLARTTAMDYWGQGSLVTVSS

SEQ ID NO: 194 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKTSTSGRSANPRGNQFSLRLSSVTAADTAVYYCARSLARTTAMDYWGQGSLVTVSS

SEQ ID NO: 195 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNTSTSGRSANPRGQFSLRLSSVTAADTAVYYCARSLARTTAMDYWGQGSLVTVSS

SEQ ID NO: 196 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQTSTSGRSANPRGFSLRLSSVTAADTAVYYCARSLARTTAMDYWGQGSLVTVSS

SEQ ID NO: 197 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTTSTSGRSANPRGAADTAVYYCARSLARTTAMDYWGQGSLVTVSS

SEQ ID NO: 198 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTATSTSGRSANPRGADTAVYYCARSLARTTAMDYWGQGSLVTVSS

SEQ ID NO: 199 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAATSTSGRSANPRGDTAVYYCARSLARTTAMDYWGQGSLVTVSS

SEQ ID NO: 200 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSTSTSGRSANPRGLARTTAMDYWGQGSLVTVSS

SEQ ID NO: 201 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLTSTSGRSANPRGARTTAMDYWGQGSLVTVSS

SEQ ID NO: 202 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLATSTSGRSANPRGRTTAMDYWGQGSLVTVSS

SEQ ID NO: 203 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTSTSGRSANPRGTTAMDYWGQGSLVTVSS

SEQ ID NO: 204 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWTSTSGRSANPRGGQGSLVTVSS

SEQ ID NO: 205 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGTSTSGRSANPRGQGSLVTVSS

SEQ ID NO: 206 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQTSTSGRSANPRGGSLVTVSS

SEQ ID NO: 207 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGTSTSGRSANPRGSLVTVSS

SEQ ID NO: 208 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSTSTSGRSANPRGLVTVSS

SEQ ID NO: 209 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLTSTSGRSANPRGVTVSS

SEQ ID NO: 210 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTSTSGRSANPRGTVSS

SEQ ID NO: 211 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTTSTSGRSANPRGVSS

SEQ ID NO: 212 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVTSTSGRSANPRGSS

SEQ ID NO: 213 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSTSTSGRSANPRGS

SEQ ID NO: 214 - protein, 131 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSTSTSGRSANPRG

SEQ ID NO: 215 - protein, 340 aa, Artificial sequence
  an artificially synthesized sequence
ATSTSGRSANPRGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 216 - protein, 340 aa, Artificial sequence
  an artificially synthesized sequence
ASTSTSGRSANPRGTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 217 - protein, 340 aa, Artificial sequence
  an artificially synthesized sequence
ASTTSTSGRSANPRGKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 218 - protein, 340 aa, Artificial sequence
  an artificially synthesized sequence
ASTKTSTSGRSANPRGGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 219 - protein, 340 aa, Artificial sequence
  an artificially synthesized sequence
ASTKGTSTSGRSANPRGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 220 - protein, 340 aa, Artificial sequence
  an artificially synthesized sequence
ASTKGPTSTSGRSANPRGSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 221 - protein, 340 aa, Artificial sequence
  an artificially synthesized sequence
ASTKGPSTSTSGRSANPRGVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 222 - protein, 340 aa, Artificial sequence
  an artificially synthesized sequence
ASTKGPSVFPLATSTSGRSANPRGPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 223 - protein, 340 aa, Artificial sequence
  an artificially synthesized sequence
ASTKGPSVFPLAPTSTSGRSANPRGSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 224 - protein, 340 aa, Artificial sequence
  an artificially synthesized sequence
ASTKGPSVFPLAPSTSTSGRSANPRGSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 225 - protein, 340 aa, Artificial sequence
  an artificially synthesized sequence
ASTKGPSVFPLAPSSTSTSGRSANPRGKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 226 - protein, 340 aa, Artificial sequence
  an artificially synthesized sequence
ASTKGPSVFPLAPSSKSTSTSGRSANPRGTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 227 - protein, 340 aa, Artificial sequence
  an artificially synthesized sequence
ASTKGPSVFPLAPSSKSTTSTSGRSANPRGSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 228 - protein, 340 aa, Artificial sequence
  an artificially synthesized sequence
ASTKGPSVFPLAPSSKSTSGTSTSGRSANPRGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 229 - protein, 340 aa, Artificial sequence
  an artificially synthesized sequence
ASTKGPSVFPLAPSSKSTSGGTTSTSGRSANPRGAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 230 - protein, 107 aa, Artificial sequence [sequence omitted]

SEQ ID NO: 231 - protein, 107 aa, Artificial sequence [sequence omitted]

SEQ ID NO: 232 - protein, 119 aa, Artificial sequence
  an artificially synthesized sequence
DIQMTQSTSTSGRSANPRGPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 233 - protein, 119 aa, Artificial sequence
  an artificially synthesized sequence
DIQMTQSPTSTSGRSANPRGSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 234 - protein, 119 aa, Artificial sequence
  an artificially synthesized sequence
DIQMTQSPSTSTSGRSANPRGSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 235 - protein, 119 aa, Artificial sequence
  an artificially synthesized sequence
DIQMTQSPSSTSTSGRSANPRGLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 236 - protein, 119 aa, Artificial sequence
  an artificially synthesized sequence
DIQMTQSPSSLTSTSGRSANPRGSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 237 - protein, 119 aa, Artificial sequence
  an artificially synthesized sequence
DIQMTQSPSSLSTSTSGRSANPRGASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 238 - protein, 119 aa, Artificial sequence
  an artificially synthesized sequence
DIQMTQSPSSLSATSTSGRSANPRGSVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 239 - protein, 119 aa, Artificial sequence
  an artificially synthesized sequence
DIQMTQSPSSLSASTSTSGRSANPRGVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 240 - protein, 119 aa, Artificial sequence
  an artificially synthesized sequence
DIQMTQSPSSLSASVTSTSGRSANPRGGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 241 - protein, 119 aa, Artificial sequence
  an artificially synthesized sequence
DIQMTQSPSSLSASVGTSTSGRSANPRGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 242 - protein, 119 aa, Artificial sequence
  an artificially synthesized sequence
DIQMTQSPSSLSASVGDTSTSGRSANPRGRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 243 - protein, 119 aa, Artificial sequence
  an artificially synthesized sequence
DIQMTQSPSSLSASVGDRTSTSGRSANPRGVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 244 - protein, 119 aa, Artificial sequence
  an artificially synthesized sequence
DIQMTQSPSSLSASVGDRVTITCRASQDISSYLNWYQQKTSTSGRSANPRGPGKAPKLLIYYTSRLHSGVPSRFSGSGSGTDFTFTISSLQPEDIATYYCQQGNTLPYTFGQGTKVEIK

SEQ ID NO: 245 - protein, 119 aa, Artificial sequence
  an artificially synthesized sequence
DIQMTQSPSSLSASVGDRVTITCRASQDISSYLNWYQQKPTSTSGRSANPRGGKAPKLLIYYTSRLHSGVPSRFSGSGSGTDFTFTISSLQPEDIATYYCQQGNTLPYTFGQGTKVEIK

SEQ ID NO: 246 - protein, 119 aa, Artificial sequence
  an artificially synthesized sequence
DIQMTQSPSSLSASVGDRVTITCRASQDISSYLNWYQQKPGTSTSGRSANPRGKAPKLLIYYTSRLHSGVPSRFSGSGSGTDFTFTISSLQPEDIATYYCQQGNTLPYTFGQGTKVEIK

SEQ ID NO: 247 - protein, 119 aa, Artificial sequence
  an artificially synthesized sequence
DIQMTQSPSSLSASVGDRVTITCRASQDISSYLNWYQQKPGKTSTSGRSANPRGAPKLLIYYTSRLHSGVPSRFSGSGSGTDFTFTISSLQPEDIATYYCQQGNTLPYTFGQGTKVEIK

SEQ ID NO: 248 - protein, 119 aa, Artificial sequence
  an artificially synthesized sequence
DIQMTQSPSSLSASVGDRVTITCRASQDISSYLNWYQQKPGKATSTSGRSANPRGPKLLIYYTSRLHSGVPSRFSGSGSGTDFTFTISSLQPEDIATYYCQQGNTLPYTFGQGTKVEIK

SEQ ID NO: 249 - protein, 119 aa, Artificial sequence
  an artificially synthesized sequence
DIQMTQSPSSLSASVGDRVTITCRASQDISSYLNWYQQKPGKAPTSTSGRSANPRGKLLIYYTSRLHSGVPSRFSGSGSGTDFTFTISSLQPEDIATYYCQQGNTLPYTFGQGTKVEIK

SEQ ID NO: 250 - protein, 119 aa, Artificial sequence
  an artificially synthesized sequence
DIQMTQSPSSLSASVGDRVTITCRASQDISSYLNWYQQKPGKAPKTSTSGRSANPRGLLIYYTSRLHSGVPSRFSGSGSGTDFTFTISSLQPEDIATYYCQQGNTLPYTFGQGTKVEIK

SEQ ID NO: 251 - protein, 119 aa, Artificial sequence
  an artificially synthesized sequence
DIQMTQSPSSLSASVGDRVTITCRASQDISSYLNWYQQKPGKAPKLLIYTSTSGRSANPRGYTSRLHSGVPSRFSGSGSGTDFTFTISSLQPEDIATYYCQQGNTLPYTFGQGTKVEIK

SEQ ID NO: 252 - protein, 119 aa, Artificial sequence
  an artificially synthesized sequence
DIQMTQSPSSLSASVGDRVTITCRASQDISSYLNWYQQKPGKAPKLLIYYTSTSGRSANPRGTSRLHSGVPSRFSGSGSGTDFTFTISSLQPEDIATYYCQQGNTLPYTFGQGTKVEIK

SEQ ID NO: 253 - protein, 119 aa, Artificial sequence
  an artificially synthesized sequence
DIQMTQSPSSLSASVGDRVTITCRASQDISSYLNWYQQKPGKAPKLLIYYTTSTSGRSANPRGSRLHSGVPSRFSGSGSGTDFTFTISSLQPEDIATYYCQQGNTLPYTFGQGTKVEIK

SEQ ID NO: 254 - protein, 119 aa, Artificial sequence
  an artificially synthesized sequence
DIQMTQSPSSLSASVGDRVTITCRASQDISSYLNWYQQKPGKAPKLLIYYTSTSTSGRSANPRGRLHSGVPSRFSGSGSGTDFTFTISSLQPEDIATYYCQQGNTLPYTFGQGTKVEIK

SEQ ID NO: 255 - protein, 119 aa, Artificial sequence
  an artificially synthesized sequence
DIQMTQSPSSLSASVGDRVTITCRASQDISSYLNWYQQKPGKAPKLLIYYTSRTSTSGRSANPRGLHSGVPSRFSGSGSGTDFTFTISSLQPEDIATYYCQQGNTLPYTFGQGTKVEIK

SEQ ID NO: 256 - protein, 119 aa, Artificial sequence
  an artificially synthesized sequence
DIQMTQSPSSLSASVGDRVTITCRASQDISSYLNWYQQKPGKAPKLLIYYTSRLTSTSGRSANPRGHSGVPSRFSGSGSGTDFTFTISSLQPEDIATYYCQQGNTLPYTFGQGTKVEIK

SEQ ID NO: 257 - protein, 119 aa, Artificial sequence
  an artificially synthesized sequence
DIQMTQSPSSLSASVGDRVTITCRASQDISSYLNWYQQKPGKAPKLLIYYTSRLHTSTSGRSANPRGSGVPSRFSGSGSGTDFTFTISSLQPEDIATYYCQQGNTLPYTFGQGTKVEIK

SEQ ID NO: 258 - protein, 119 aa, Artificial sequence
  an artificially synthesized sequence
DIQMTQSPSSLSASVGDRVTITCRASQDISSYLNWYQQKPGKAPKLLIYYTSRLHSTSTSGRSANPRGGVPSRFSGSGSGTDFTFTISSLQPEDIATYYCQQGNTLPYTFGQGTKVEIK

SEQ ID NO: 259 - protein, 119 aa, Artificial sequence
  an artificially synthesized sequence
DIQMTQSPSSLSASVGDRVTITCRASQDISSYLNWYQQKPGKAPKLLIYYTSRLHSGTSTSGRSANPRGVPSRFSGSGSGTDFTFTISSLQPEDIATYYCQQGNTLPYTFGQGTKVEIK

SEQ ID NO: 260 - protein, 119 aa, Artificial sequence
  an artificially synthesized sequence
DIQMTQSPSSLSASVGDRVTITCRASQDISSYLNWYQQKPGKAPKLLIYYTSRLHSGVTSTSGRSANPRGPSRFSGSGSGTDFTFTISSLQPEDIATYYCQQGNTLPYTFGQGTKVEIK

SEQ ID NO: 261 - protein, 119 aa, Artificial sequence
  an artificially synthesized sequence
DIQMTQSPSSLSASVGDRVTITCRASQDISSYLNWYQQKPGKAPKLLIYYTSRLHSGVPTSTSGRSANPRGSRFSGSGSGTDFTFTISSLQPEDIATYYCQQGNTLPYTFGQGTKVEIK

SEQ ID NO: 262 - protein, 119 aa, Artificial sequence
  an artificially synthesized sequence
DIQMTQSPSSLSASVGDRVTITCRASQDISSYLNWYQQKPGKAPKLLIYYTSRLHSGVPSTSTSGRSANPRGRFSGSGSGTDFTFTISSLQPEDIATYYCQQGNTLPYTFGQGTKVEIK

SEQ ID NO: 263 - protein, 119 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTSTSGRSANPRGTFGQGTKVEIK

SEQ ID NO: 264 - protein, 119 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTTSTSGRSANPRGFGQGTKVEIK

SEQ ID NO: 265 - protein, 119 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFTSTSGRSANPRGGQGTKVEIK

SEQ ID NO: 266 - protein, 119 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGTSTSGRSANPRGQGTKVEIK

SEQ ID NO: 267 - protein, 119 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQTSTSGRSANPRGGTKVEIK

SEQ ID NO: 268 - protein, 119 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTSTSGRSANPRGTKVEIK

SEQ ID NO: 269 - protein, 119 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTTSTSGRSANPRGKVEIK

SEQ ID NO: 270 - protein, 119 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKTSTSGRSANPRGVEIK

SEQ ID NO: 271 - protein, 119 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVTSTSGRSANPRGEIK

SEQ ID NO: 272 - protein, 119 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVETSTSGRSANPRGIK

SEQ ID NO: 273 - protein, 119 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEITSTSGRSANPRGK

SEQ ID NO: 274 - protein, 119 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKTSTSGRSANPRG

SEQ ID NO: 275 - protein, 119 aa, Artificial sequence
  an artificially synthesized sequence
RTSTSGRSANPRGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 276 - protein, 119 aa, Artificial sequence
  an artificially synthesized sequence
RTTSTSGRSANPRGVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 277 - protein, 119 aa, Artificial sequence
  an artificially synthesized sequence
RTVTSTSGRSANPRGAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 278 - protein, 119 aa, Artificial sequence
  an artificially synthesized sequence
RTVATSTSGRSANPRGAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 279 - protein, 119 aa, Artificial sequence
  an artificially synthesized sequence
RTVAATSTSGRSANPRGPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 280 - protein, 119 aa, Artificial sequence
  an artificially synthesized sequence
RTVAAPTSTSGRSANPRGSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 281 - protein, 119 aa, Artificial sequence
  an artificially synthesized sequence
RTVAAPSVTSTSGRSANPRGFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 282 - protein, 119 aa, Artificial sequence
  an artificially synthesized sequence
RTVAAPSVFTSTSGRSANPRGIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 283 - protein, 119 aa, Artificial sequence
  an artificially synthesized sequence
RTVAAPSVFITSTSGRSANPRGFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 284 - protein, 119 aa, Artificial sequence
  an artificially synthesized sequence
RTVAAPSVFIFTSTSGRSANPRGPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 285 - protein, 119 aa, Artificial sequence
  an artificially synthesized sequence
RTVAAPSVFIFPTSTSGRSANPRGPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 286 - protein, 119 aa, Artificial sequence
  an artificially synthesized sequence
RTVAAPSVFIFPPTSTSGRSANPRGSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 287 - protein, 119 aa, Artificial sequence
  an artificially synthesized sequence
RTVAAPSVFIFPPSTSTSGRSANPRGDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 288 - protein, 119 aa, Artificial sequence
  an artificially synthesized sequence
RTVAAPSVFIFPPSDTSTSGRSANPRGEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 289 - protein, 119 aa, Artificial sequence
  an artificially synthesized sequence
RTVAAPSVFIFPPSDETSTSGRSANPRGQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 290 - protein, 119 aa, Artificial sequence
  an artificially synthesized sequence
RTVAAPSVFIFPPSDEQTSTSGRSANPRGLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 291 - protein, 119 aa, Artificial sequence
  an artificially synthesized sequence
RTVAAPSVFIFPPSDEQLTSTSGRSANPRGKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 292 - protein, 119 aa, Artificial sequence
  an artificially synthesized sequence
RTVAAPSVFIFPPSDEQLKTSTSGRSANPRGSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 293 - protein, 119 aa, Artificial sequence
  an artificially synthesized sequence
RTVAAPSVFIFPPSDEQLKSTSTSGRSANPRGGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 294 - protein, 119 aa, Artificial sequence
  an artificially synthesized sequence
RTVAAPSVFIFPPSDEQLKSGTSTSGRSANPRGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 295 - protein, 119 aa, Artificial sequence
  an artificially synthesized sequence
RTVAAPSVFIFPPSDEQLKSGTTSTSGRSANPRGASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 296 - protein, 119 aa, Artificial sequence
  an artificially synthesized sequence
RTVAAPSVFIFPPSDEQLKSGTATSTSGRSANPRGSVVCLLNNFYPREAKVQWKVDNALQSGNSQESVTEQDSKDSTYSLSSTLTLSKADYEKHKVYACEVTHQGLSSPVTKSFNRGEC

SEQ ID NO: 297 - protein, 441 aa, Artificial sequence
  an artificially synthesized sequence
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 298 - protein, 214 aa, Artificial sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 299 - protein, 12 aa, Artificial sequence
  an artificially synthesized sequence
TSTSGRSANPRG

SEQ ID NO: 300 - protein, 113 aa, Artificial sequence [sequence omitted]

SEQ ID NO: 301 - protein, 328 aa, Artificial sequence; identical to SEQ ID NO: 162
  an artificially synthesized sequence

SEQ ID NO: 302 - protein, 107 aa, Artificial sequence [sequence omitted]

SEQ ID NO: 303 - protein, 107 aa, Artificial sequence [sequence omitted]

SEQ ID NO: 304 - protein, 453 aa, Artificial sequence
  an artificially synthesized sequence
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSTSTSGRSANPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 305 - protein, 453 aa, Artificial sequence
  an artificially synthesized sequence
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSATSTSGRSANPRGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 306 - protein, 226 aa, Artificial sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVTSTSGRSANPRGEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 307 - protein, 226 aa, Artificial sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVETSTSGRSANPRGIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 308 - protein, 226 aa, Artificial sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEITSTSGRSANPRGKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 309 - protein, 226 aa, Artificial sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKTSTSGRSANPRGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 310 - protein, 226 aa, Artificial sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTSTSGRSANPRGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 311 - protein, 226 aa, Artificial sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTTSTSGRSANPRGVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 312 - protein, 226 aa, Artificial sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVTSTSGRSANPRGAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 313 - protein, 226 aa, Artificial sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVATSTSGRSANPRGAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 314 - protein, 226 aa, Artificial sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAATSTSGRSANPRGPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 315 - protein, 226 aa, Artificial sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPTSTSGRSANPRGSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 316 - protein, 15 aa, Artificial sequence
  an artificially synthesized sequence
GLNDIFEAQKIEWHE

SEQ ID NO: 317 - protein, 461 aa, Artificial sequence
  an artificially synthesized sequence
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGLNDIFEAQKIEWHE

SEQ ID NO: 318 - protein, 641 aa, Artificial sequence
  an artificially synthesized sequence
MSDEGPGTGPGNGLGEKGDTSGPEGSGGSGPQRRGGDNHGRGRGRGRGRGGGRPGAPGGSGSGPRHRDGVRRPQKRPSCIGCKGTHGGTGAGAGAGGAGAGGAGAGGGAGAGGGAGGAGGAGGAGAGGGAGAGGGAGGAGGAGAGGGAGAGGGAGGAGAGGGAGGAGGAGAGGGAGAGGGAGGAGAGGGAGGAGGAGAGGGAGAGGAGGAGGAGAGGAGAGGGAGGAGGAGAGGAGAGGAGAGGAGAGGAGGAGAGGAGGAGAGGAGGAGAGGGAGGAGAGGGAGGAGAGGAGGAGAGGAGGAGAGGAGGAGAGGGAGAGGAGAGGGGRGRGGSGGRGRGGSGGRGRGGSGGRRGRGRERARGGSRERARGRGRGRGEKRPRSPSSQSSSSGSPPRRPPPGRRPFFHPVGEADYFEYHQEGGPDGEPDVPPGAIEQGPADDPGEGPSTGPRGQGDGGRRKKGGWFGKHRGQGGSNPKFENIAEGLRALLARSHVERTTDEGTWVAGVFVYGGSKTSLYNLRRGTALAIPQCRLTPLSRLPFGMAPGPGPQPGPLRESIVCYFMVFLQTHIFAEVLKDAIKDLVMTKPAPTCNIRVTVCSFDDGVDLPPWFPPMVEGAAAEGDDGDDGDEGGDGDEGEEGQE

SEQ ID NO: 319 - protein, 347 aa, Artificial sequence
  an artificially synthesized sequence
MVLASSTTSIHTMLLLLLMLAQPAMAMKDNTVPLKLIALLANGEFHSGEQLGETLGMSRAAINKHIQTLRDWGVDVFTVPGKGYSLPEPIQLLNAKQILGQLDGGSVAVLPVIDSTNQYLLDRIGELKSGDACIAEYQQAGRGRRGRKWFSPFGANLYLSMFWRLEQGPAAAIGLSLVIGIVMAEVLRKLGADKVRVKWPNDLYLQDRKLAGILVELTGKTGDAAQIVIGAGINMAMRRVEESVVNQGWITLQEAGINLDRNTLAAMLIRELRAALELFEQEGLAPYLSRWEKLDNFINRPVKLIIGDKEIFGISRGIDKQGALLLEQDGIIKPWMGGEISLRSAEK

SEQ ID NO: 320 - protein, 147 aa, Artificial sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQ

SEQ ID NO: 321 - protein, 25 aa, Artificial sequence
  an artificially synthesized sequence
GGGGSGGGGSGGGGSGGGGSGGGGS

SEQ ID NO: 322 - protein, 226 aa, Artificial sequence
  an artificially synthesized sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKTSTSGRSANPRGVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 323 - protein, 625 aa, Artificial sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSTSTSGRSANPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 324 - protein, 625 aa, Artificial sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSATSTSGRSANPRGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 325 - protein, 398 aa, Artificial sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKTSTSGRSANPRGVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 326 - protein, 398 aa, Artificial sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVTSTSGRSANPRGEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 327 - protein, 398 aa, Artificial sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVETSTSGRSANPRGIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 328 - protein, 398 aa, Artificial sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEITSTSGRSANPRGKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 329 - protein, 398 aa, Artificial sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTSTSGRSANPRGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 330 - protein, 398 aa, Artificial sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTTSTSGRSANPRGVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 331 - protein, 398 aa, Artificial sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVTSTSGRSANPRGAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 332 - protein, 398 aa, Artificial sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVATSTSGRSANPRGAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 333 - protein, 398 aa, Artificial sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAATSTSGRSANPRGPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 334 - protein, 398 aa, Artificial sequence
  an artificially synthesized sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPTSTSGRSANPRGSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 335 - protein, 12 aa, Artificial sequence
  an artificially synthesized sequence
TSGSGRSANARG

SEQ ID NO: 336 - protein, 12 aa, Artificial sequence
  an artificially synthesized sequence
TSQSGRSANQRG

SEQ ID NO: 337 - protein, 12 aa, Artificial sequence
  an artificially synthesized sequence
TSPSGRSAYPRG

SEQ ID NO: 338 - protein, 12 aa, Artificial sequence
  an artificially synthesized sequence
TSGSGRSATPRG

SEQ ID NO: 339 - protein, 12 aa, Artificial sequence
  an artificially synthesized sequence
TSQSGRSATPRG

SEQ ID NO: 340 - protein, 12 aa, Artificial sequence
  an artificially synthesized sequence
TSASGRSATPRG

SEQ ID NO: 341 - protein, 12 aa, Artificial sequence
  an artificially synthesized sequence
TSYSGRSAVPRG

SEQ ID NO: 342 - protein, 12 aa, Artificial sequence
  an artificially synthesized sequence
TSYSGRSANFRG

SEQ ID NO: 343 - protein, 12 aa, Artificial sequence
  an artificially synthesized sequence
TSSSGRSATPRG

SEQ ID NO: 344 - protein, 12 aa, Artificial sequence
  an artificially synthesized sequence
TSTTGRSASPRG

SEQ ID NO: 345 - protein, 12 aa, Artificial sequence
  an artificially synthesized sequence
TSTSGRSANPRG

SEQ ID NO: 346 - protein, 464 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSTSGSGRSANARGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 347 - protein, 464 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSTSQSGRSANQRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 348 - protein, 464 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSTSPSGRSAYPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 349 - protein, 464 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSTSGSGRSATPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 350 - protein, 464 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSTSQSGRSATPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 351 - protein, 464 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSTSASGRSATPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 352 - protein, 464 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSTSYSGRSAVPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 353 - protein, 464 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSTSYSGRSANFRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 354 - protein, 464 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSTSSSGRSATPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 355 - protein, 464 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSTSTTGRSASPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 356 - protein, 464 aa, Artificial sequence
  an artificially synthesized sequence
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSTSTSGRSANPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 357 - protein, 474 aa, Artificial sequence
  an artificially synthesized sequence
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTTVTVSSTSGSGRSANARGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 358 - protein, 474 aa, Artificial sequence
  an artificially synthesized sequence
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTTVTVSSTSQSGRSANQRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 359 - protein, 474 aa, Artificial sequence
  an artificially synthesized sequence
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTTVTVSSTSPSGRSAYPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 360 - protein, 474 aa, Artificial sequence
  an artificially synthesized sequence
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTTVTVSSTSGSGRSATPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 361 - protein, 474 aa, Artificial sequence
  an artificially synthesized sequence
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTTVTVSSTSQSGRSATPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 362 - protein, 474 aa, Artificial sequence
  an artificially synthesized sequence
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTTVTVSSTSASGRSATPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 363 - protein, 474 aa, Artificial sequence
  an artificially synthesized sequence
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTTVTVSSTSYSGRSAVPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 364 - protein, 474 aa, Artificial sequence
  an artificially synthesized sequence
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTTVTVSSTSYSGRSANFRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 365 - protein, 474 aa, Artificial sequence
  an artificially synthesized sequence
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTTVTVSSTSSSGRSATPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 366 - protein, 474 aa, Artificial sequence
  an artificially synthesized sequence
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTTVTVSSTSTTGRSASPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 367 - protein, 474 aa, Artificial sequence
  an artificially synthesized sequence
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTTVTVSSTSTSGRSANPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 368 - protein, 462 aa, Artificial sequence
  an artificially synthesized sequence
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 369 - protein, 216 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 370 - protein, 77 aa, Artificial sequence
  an artificially synthesized sequence
VPLSRTVRCTCISISNQPVNPRSLEKLEIIPASQFCPRVEIIATMKKKGEKRCLNPESKAIKNLLKAVSKERSKASP

SEQ ID NO: 371 - protein, 302 aa, Artificial sequence
  an artificially synthesized sequence
VPLSRTVRCTCISISNQPVNPRSLEKLEIIPASQFCPRVEIIATMKKKGEKRCLNPESKAIKNLLKAVSKERSKASPGGGGSGGGGQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 372 - protein, 314 aa, Artificial sequence
  an artificially synthesized sequence
VPLSRTVRCTCISISNQPVNPRSLEKLEIIPASQFCPRVEIIATMKKKGEKRCLNPESKAIKNLLKAVSKERSKASPGGGGSGGGGQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSGSGRSATPRGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 373 - protein, 85 aa, Artificial sequence
  an artificially synthesized sequence
VPLSRTVRCTCISISNQPVNPRSLEKLEIIPASQFCPRVEIIATMKKKGEKRCLNPESKAIKNLLKAVSKERSKASPHHHHHHHH

SEQ ID NO: 374 - protein, 5 aa, Artificial sequence
  an artificially synthesized sequence
SFSIT

SEQ ID NO: 375 - protein, 17 aa, Artificial sequence
  an artificially synthesized sequence
EITPMFGIANYAQKFQG

SEQ ID NO: 376 - protein, 25 aa, Artificial sequence
  an artificially synthesized sequence
DGRFDVSDLLTDKPKVTINYNGMDV

SEQ ID NO: 377 - protein, 13 aa, Artificial sequence
  an artificially synthesized sequence
SGSSSNIGSNTVN

SEQ ID NO: 378 - protein, 7 aa, Artificial sequence
  an artificially synthesized sequence
NNDQRPS

SEQ ID NO: 379 - protein, 11 aa, Artificial sequence
  an artificially synthesized sequence
ASWDDSLNGRV

SEQ ID NO: 380 - protein, 5 aa, Artificial sequence
  an artificially synthesized sequence
NNGMH

SEQ ID NO: 381 - protein, 17 aa, Artificial sequence
  an artificially synthesized sequence
VIWFDGMNKFYVDSVKG

SEQ ID NO: 382 - protein, 15 aa, Artificial sequence
  an artificially synthesized sequence
EGDGSGIYYYYGMDV

SEQ ID NO: 383 - protein, 12 aa, Artificial sequence
  an artificially synthesized sequence
RASQSVSSSYLA

SEQ ID NO: 384 - protein, 7 aa, Artificial sequence
  an artificially synthesized sequence
GASSRAT

SEQ ID NO: 385 - protein, 10 aa, Artificial sequence
  an artificially synthesized sequence
QQYGSSPIFT

SEQ ID NO: 386 - protein, 5 aa, Artificial sequence
  an artificially synthesized sequence
TYWLG

SEQ ID NO: 387 - protein, 17 aa, Artificial sequence
  an artificially synthesized sequence
IMSPVDSDIRYSPSFQG

SEQ ID NO: 388 - protein, 10 aa, Artificial sequence
  an artificially synthesized sequence
RRPGQGYFDF

SEQ ID NO: 389 - protein, 11 aa, Artificial sequence
  an artificially synthesized sequence
RASQGISSWLA

SEQ ID NO: 390 - protein, 7 aa, Artificial sequence
  an artificially synthesized sequence
AASSLQS

SEQ ID NO: 391 - protein, 9 aa, Artificial sequence
  an artificially synthesized sequence
QQYNIYPYT

SEQ ID NO: 392 - protein, 5 aa, Artificial sequence
  an artificially synthesized sequence
NSGMH

SEQ ID NO: 393 - protein, 17 aa, Artificial sequence
  an artificially synthesized sequence
VIWYDGSKRYYADSVKG

SEQ ID NO: 394 - protein, 4 aa, Artificial sequence
  an artificially synthesized sequence
NDDY

SEQ ID NO: 395 - protein, 11 aa, Artificial sequence
  an artificially synthesized sequence
RASQSVSSYLA

SEQ ID NO: 396 - protein, 7 aa, Artificial sequence
  an artificially synthesized sequence
DASNRAT

SEQ ID NO: 397 - protein, 9 aa, Artificial sequence
  an artificially synthesized sequence
QQSSNWPRT

SEQ ID NO: 398 - protein, 6 aa, Artificial sequence
  an artificially synthesized sequence
SDHAWS

SEQ ID NO: 399 - protein, 16 aa, Artificial sequence
  an artificially synthesized sequence
YISYSGITTYNPSLKS

SEQ ID NO: 400 - protein, 10 aa, Artificial sequence
  an artificially synthesized sequence
SLARTTAMDY

SEQ ID NO: 401 - protein, 11 aa, Artificial sequence
  an artificially synthesized sequence
RASQDISSYLN

SEQ ID NO: 402 - protein, 7 aa, Artificial sequence
  an artificially synthesized sequence
YTSRLHS

SEQ ID NO: 403 - protein, 9 aa, Artificial sequence
  an artificially synthesized sequence
QQGNTLPYT

SEQ ID NO: 404 - protein, 459 aa, Artificial sequence
  an artificially synthesized sequence
QVQLQESTSTSGRSANPRGGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 405 - protein, 459 aa, Artificial sequence
  an artificially synthesized sequence
QVQLQESGTSTSGRSANPRGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 406 - protein, 459 aa, Artificial sequence
  an artificially synthesized sequence
QVQLQESGPTSTSGRSANPRGGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 407 - protein, 459 aa, Artificial sequence
  an artificially synthesized sequence
QVQLQESGPGTSTSGRSANPRGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 408 - protein, 459 aa, Artificial sequence
  an artificially synthesized sequence
QVQLQESGPGLTSTSGRSANPRGVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 409 - protein, 459 aa, Artificial sequence
  an artificially synthesized sequence
QVQLQESGPGLVTSTSGRSANPRGRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 410 - protein, 459 aa, Artificial sequence
  an artificially synthesized sequence
QVQLQESGPGLVRTSTSGRSANPRGPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 411 - protein, 459 aa, Artificial sequence
  an artificially synthesized sequence
QVQLQESGPGLVRPTSTSGRSANPRGSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 412 - protein, 459 aa, Artificial sequence
  an artificially synthesized sequence
QVQLQESGPGLVRPSTSTSGRSANPRGQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 413 - protein, 459 aa, Artificial sequence
  an artificially synthesized sequence
QVQLQESGPGLVRPSQTLSLTCTVSGYSITSDHAWSWVRQPTSTSGRSANPRGPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 414 - protein, 459 aa, Artificial sequence
  an artificially synthesized sequence
QVQLQESGPGLVRPSQTLSLTCTVSGYSITSDHAWSWVRQPPTSTSGRSANPRGGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 415 - protein, 459 aa, Artificial sequence
  an artificially synthesized sequence
QVQLQESGPGLVRPSQTLSLTCTVSGYSITSDHAWSWVRQPPGTSTSGRSANPRGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 416 - protein, 459 aa, Artificial sequence
  an artificially synthesized sequence
QVQLQESGPGLVRPSQTLSLTCTVSGYSITSDHAWSWVRQPPGRTSTSGRSANPRGGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 417 - protein, 459 aa, Artificial sequence
  an artificially synthesized sequence
QVQLQESGPGLVRPSQTLSLTCTVSGYSITSDHAWSWVRQPPGRGTSTSGRSANPRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 418 - protein, 459 aa, Artificial sequence
  an artificially synthesized sequence
QVQLQESGPGLVRPSQTLSLTCTVSGYSITSDHAWSWVRQPPGRGLTSTSGRSANPRGEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 419 - protein, 459 aa, Artificial sequence
  an artificially synthesized sequence
QVQLQESGPGLVRPSQTLSLTCTVSGYSITSDHAWSWVRQPPGRGLEWIGYISYSGTSTSGRSANPRGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 420 - protein, 459 aa, Artificial sequence
  an artificially synthesized sequence
QVQLQESGPGLVRPSQTLSLTCTVSGYSITSDHAWSWVRQPPGRGLEWIGYISYSGITSTSGRSANPRGTTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 421 - protein, 459 aa, Artificial sequence
  an artificially synthesized sequence
QVQLQESGPGLVRPSQTLSLTCTVSGYSITSDHAWSWVRQPPGRGLEWIGYISYSGITTSTSGRSANPRGTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 422 - protein, 459 aa, Artificial sequence
  an artificially synthesized sequence
QVQLQESGPGLVRPSQTLSLTCTVSGYSITSDHAWSWVRQPPGRGLEWIGYISYSGITTTSTSGRSANPRGYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 423 - protein, 459 aa, Artificial sequence
  an artificially synthesized sequence
QVQLQESGPGLVRPSQTLSLTCTVSGYSITSDHAWSWVRQPPGRGLEWIGYISYSGITTYTSTSGRSANPRGNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 424 - protein, 459 aa, Artificial sequence
  an artificially synthesized sequence
QVQLQESGPGLVRPSQTLSLTCTVSGYSITSDHAWSWVRQPPGRGLEWIGYISYSGITTYNTSTSGRSANPRGPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 425 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPTSTSGRSANPRGSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 426 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSTSTSGRSANPRGLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 427 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLTSTSGRSANPRGKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 428 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKTSTSGRSANPRGSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 429 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSTSTSGRSANPRGRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 430 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRTSTSGRSANPRGVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 431 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTSTSGRSANPRGTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 432 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTTSTSGRSANPRGMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 433 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTTSTSGRSANPRGSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 434 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSTSTSGRSANPRGKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 435 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKTSTSGRSANPRGNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 436 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNTSTSGRSANPRGQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 437 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQTSTSGRSANPRGFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 438 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTTSTSGRSANPRGAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 439 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTATSTSGRSANPRGADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 440 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAATSTSGRSANPRGDTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 441 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSTSTSGRSANPRGLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 442 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLTSTSGRSANPRGARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 443 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLATSTSGRSANPRGRTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 444 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTSTSGRSANPRGTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 445 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWTSTSGRSANPRGGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 446 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGTSTSGRSANPRGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 447 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQTSTSGRSANPRGGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 448 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGTSTSGRSANPRGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 449 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSTSTSGRSANPRGLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 450 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLTSTSGRSANPRGVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 451 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTSTSGRSANPRGTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 452 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTTSTSGRSANPRGVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 453 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVTSTSGRSANPRGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 454 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSTSTSGRSANPRGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 455 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSTSTSGRSANPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 456 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSATSTSGRSANPRGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 457 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTSTSGRSANPRGTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 458 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTTSTSGRSANPRGKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 459 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKTSTSGRSANPRGGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 460 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGTSTSGRSANPRGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 461 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPTSTSGRSANPRGSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 462 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSTSTSGRSANPRGVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 463 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLATSTSGRSANPRGPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 464 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPTSTSGRSANPRGSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 465 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSTSTSGRSANPRGSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 466 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSTSTSGRSANPRGKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 467 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSTSGRSANPRGTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 468 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTTSTSGRSANPRGSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 469 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGTSTSGRSANPRGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 470 - protein, 459 aa, Artificial sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTTSTSGRSANPRGAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 471 - protein, 226 aa, Artificial sequence
  an artificially synthesized sequence
DIQMTQSTSTSGRSANPRGPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 472 - protein, 226 aa, Artificial sequence
  an artificially synthesized sequence
DIQMTQSPTSTSGRSANPRGSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 473 - protein, 226 aa, Artificial sequence
  an artificially synthesized sequence
DIQMTQSPSTSTSGRSANPRGSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 474 - protein, 226 aa, Artificial sequence
  an artificially synthesized sequence
DIQMTQSPSSTSTSGRSANPRGLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 475 - protein, 226 aa, Artificial sequence
  an artificially synthesized sequence
DIQMTQSPSSLTSTSGRSANPRGSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 476 - protein, 226 aa, Artificial sequence
  an artificially synthesized sequence
DIQMTQSPSSLSTSTSGRSANPRGASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 477 - protein, 226 aa, Artificial sequence
  an artificially synthesized sequence
DIQMTQSPSSLSATSTSGRSANPRGSVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 478 - protein, 226 aa, Artificial sequence
  an artificially synthesized sequence
DIQMTQSPSSLSASTSTSGRSANPRGVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 479 - protein, 226 aa, Artificial sequence
  an artificially synthesized sequence
DIQMTQSPSSLSASVTSTSGRSANPRGGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 480 - protein, 226 aa, Artificial sequence
  an artificially synthesized sequence
DIQMTQSPSSLSASVGTSTSGRSANPRGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 481 - protein, 226 aa, Artificial sequence
  an artificially synthesized sequence
DIQMTQSPSSLSASVGDTSTSGRSANPRGRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 482 - protein, 226 aa, Artificial sequence
  an artificially synthesized sequence
DIQMTQSPSSLSASVGDRTSTSGRSANPRGVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 483 - protein, 226 aa, Artificial sequence
  an artificially synthesized sequence
DIQMTQSPSSLSASVGDRVTITCRASQDISSYLNWYQQKTSTSGRSANPRGPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 484 - protein, 226 aa, Artificial sequence
  an artificially synthesized sequence
DIQMTQSPSSLSASVGDRVTITCRASQDISSYLNWYQQKPTSTSGRSANPRGGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 485 - protein, 226 aa, Artificial sequence
  an artificially synthesized sequence
DIQMTQSPSSLSASVGDRVTITCRASQDISSYLNWYQQKPGTSTSGRSANPRGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 486 - protein, 226 aa, Artificial sequence
  an artificially synthesized sequence
DIQMTQSPSSLSASVGDRVTITCRASQDISSYLNWYQQKPGKTSTSGRSANPRGAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 487 - protein, 226 aa, Artificial sequence
  an artificially synthesized sequence
DIQMTQSPSSLSASVGDRVTITCRASQDISSYLNWYQQKPGKATSTSGRSANPRGPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 488 - protein, 226 aa, Artificial sequence
  an artificially synthesized sequence
DIQMTQSPSSLSASVGDRVTITCRASQDISSYLNWYQQKPGKAPTSTSGRSANPRGKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 489 - protein, 226 aa, Artificial sequence
  an artificially synthesized sequence
DIQMTQSPSSLSASVGDRVTITCRASQDISSYLNWYQQKPGKAPKTSTSGRSANPRGLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 490 - protein, 226 aa, Artificial sequence
  an artificially synthesized sequence
DIQMTQSPSSLSASVGDRVTITCRASQDISSYLNWYQQKPGKAPKLLIYTSTSGRSANPRGYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 491 - protein, 226 aa, Artificial sequence
  an artificially synthesized sequence
DIQMTQSPSSLSASVGDRVTITCRASQDISSYLNWYQQKPGKAPKLLIYYTSTSGRSANPRGTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 492 - protein, 226 aa, Artificial sequence
  an artificially synthesized sequence
DIQMTQSPSSLSASVGDRVTITCRASQDISSYLNWYQQKPGKAPKLLIYYTTSTSGRSANPRGSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 493 - protein, 226 aa, Artificial sequence
  an artificially synthesized sequence
DIQMTQSPSSLSASVGDRVTITCRASQDISSYLNWYQQKPGKAPKLLIYYTSTSTSGRSANPRGRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 494 - protein, 226 aa, Artificial sequence
  an artificially synthesized sequence
DIQMTQSPSSLSASVGDRVTITCRASQDISSYLNWYQQKPGKAPKLLIYYTSRTSTSGRSANPRGLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 495 - protein, 226 aa, Artificial sequence
  an artificially synthesized sequence
DIQMTQSPSSLSASVGDRVTITCRASQDISSYLNWYQQKPGKAPKLLIYYTSRLTSTSGRSANPRGHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 496 - protein, 226 aa, Artificial sequence
  an artificially synthesized sequence
DIQMTQSPSSLSASVGDRVTITCRASQDISSYLNWYQQKPGKAPKLLIYYTSRLHTSTSGRSANPRGSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 497 - protein, 226 aa, Artificial sequence
  an artificially synthesized sequence
DIQMTQSPSSLSASVGDRVTITCRASQDISSYLNWYQQKPGKAPKLLIYYTSRLHSTSTSGRSANPRGGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 498 - protein, 226 aa, Artificial sequence
  an artificially synthesized sequence
DIQMTQSPSSLSASVGDRVTITCRASQDISSYLNWYQQKPGKAPKLLIYYTSRLHSGTSTSGRSANPRGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 499 - protein, 226 aa, Artificial sequence
  an artificially synthesized sequence
DIQMTQSPSSLSASVGDRVTITCRASQDISSYLNWYQQKPGKAPKLLIYYTSRLHSGVTSTSGRSANPRGPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 500 - protein, 226 aa, Artificial sequence
  an artificially synthesized sequence
DIQMTQSPSSLSASVGDRVTITCRASQDISSYLNWYQQKPGKAPKLLIYYTSRLHSGVPTSTSGRSANPRGSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 501 - protein, 226 aa, Artificial sequence
  an artificially synthesized sequence
DIQMTQSPSSLSASVGDRVTITCRASQDISSYLNWYQQKPGKAPKLLIYYTSRLHSGVPSTSTSGRSANPRGRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 502 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTSTSGRSANPRGTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 503 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTTSTSGRSANPRGFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 504 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFTSTSGRSANPRGGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 505 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGTSTSGRSANPRGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 506 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQTSTSGRSANPRGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 507 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTSTSGRSANPRGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 508 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTTSTSGRSANPRGKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 509 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKTSTSGRSANPRGVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 510 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVTSTSGRSANPRGEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 511 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVETSTSGRSANPRGIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 512 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEITSTSGRSANPRGKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 513 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKTSTSGRSANPRGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 514 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTSTSGRSANPRGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 515 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTTSTSGRSANPRGVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 516 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVTSTSGRSANPRGAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 517 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVATSTSGRSANPRGAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 518 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAATSTSGRSANPRGPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 519 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPTSTSGRSANPRGSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 520 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVTSTSGRSANPRGFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 521 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFTSTSGRSANPRGIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 522 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFITSTSGRSANPRGFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 523 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFTSTSGRSANPRGPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 524 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPTSTSGRSANPRGPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 525 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPTSTSGRSANPRGSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 526 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSTSTSGRSANPRGDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 527 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDTSTSGRSANPRGEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 528 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDETSTSGRSANPRGQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 529 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQTSTSGRSANPRGLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 530 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLTSTSGRSANPRGKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 531 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKTSTSGRSANPRGSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 532 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSTSTSGRSANPRGGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 533 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTSTSGRSANPRGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 534 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTTSTSGRSANPRGASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 535 - protein, 226 aa, Artificial sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTATSTSGRSANPRGSVVCLLNNFYPREAKVQWKVDNALQSGNSQESVTEQDSKDSTYSLSSTLTLSKADYEKHKVYACEVTHQGLSSPVTKSFNRGEC

SEQ ID NO: 536 - protein, 19 aa, Artificial sequence
  an artificially synthesized sequence
MGWSCIILFLVATATGVHS

SEQ ID NO: 537 - protein, 6 aa, Artificial sequence
  an artificially synthesized sequence
MYPPPY

SEQ ID NO: 538 - protein, 12 aa, Artificial sequence
  an artificially synthesized sequence
TSASGRSANPRG

SEQ ID NO: 539 - protein, 12 aa, Artificial sequence
  an artificially synthesized sequence
TSESGRSANPRG

SEQ ID NO: 540 - protein, 12 aa, Artificial sequence
  an artificially synthesized sequence
TSFSGRSANPRG

SEQ ID NO: 541 - protein, 12 aa, Artificial sequence
  an artificially synthesized sequence
TSGSGRSANPRG

SEQ ID NO: 542 - protein, 12 aa, Artificial sequence
  an artificially synthesized sequence
TSHSGRSANPRG

SEQ ID NO: 543 - protein, 12 aa, Artificial sequence
  an artificially synthesized sequence
TSKSGRSANPRG

SEQ ID NO: 544 - protein, 12 aa, Artificial sequence
  an artificially synthesized sequence
TSMSGRSANPRG

SEQ ID NO: 545 - protein, 12 aa, Artificial sequence
  an artificially synthesized sequence
TSNSGRSANPRG

SEQ ID NO: 546 - protein, 12 aa, Artificial sequence
  an artificially synthesized sequence
TSPSGRSANPRG

SEQ ID NO: 547 - protein, 12 aa, Artificial sequence
  an artificially synthesized sequence
TSQSGRSANPRG

SEQ ID NO: 548 - protein, 12 aa, Artificial sequence
  an artificially synthesized sequence
TSWSGRSANPRG

SEQ ID NO: 549 - protein, 12 aa, Artificial sequence
  an artificially synthesized sequence
TSYSGRSANPRG

SEQ ID NO: 550 - protein, 12 aa, Artificial sequence
  an artificially synthesized sequence
TSTAGRSANPRG

SEQ ID NO: 551 - protein, 12 aa, Artificial sequence
  an artificially synthesized sequence
TSTDGRSANPRG

SEQ ID NO: 552 - protein, 12 aa, Artificial sequence
  an artificially synthesized sequence
TSTEGRSANPRG

SEQ ID NO: 553 - protein, 12 aa, Artificial sequence
  an artificially synthesized sequence
TSTFGRSANPRG

SEQ ID NO: 554 - protein, 12 aa, Artificial sequence
  an artificially synthesized sequence
TSTLGRSANPRG

SEQ ID NO: 555 - protein, 12 aa, Artificial sequence
  an artificially synthesized sequence
TSTMGRSANPRG

SEQ ID NO: 556 - protein, 12 aa, Artificial sequence
  an artificially synthesized sequence
TSTPGRSANPRG

SEQ ID NO: 557 - protein, 12 aa, Artificial sequence
  an artificially synthesized sequence
TSTQGRSANPRG

SEQ ID NO: 558 - protein, 12 aa, Artificial sequence
  an artificially synthesized sequence
TSTVGRSANPRG

SEQ ID NO: 559 - protein, 12 aa, Artificial sequence
  an artificially synthesized sequence
TSTWGRSANPRG

SEQ ID NO: 560 - protein, 12 aa, Artificial sequence
  an artificially synthesized sequence
TSTSARSANPRG

SEQ ID NO: 561 - protein, 12 aa, Artificial sequence
  an artificially synthesized sequence
TSTSERSANPRG

SEQ ID NO: 562 - protein, 12 aa, Artificial sequence
  an artificially synthesized sequence
TSTSFRSANPRG

SEQ ID NO: 563 - protein, 12 aa, Artificial sequence
  an artificially synthesized sequence
TSTSHRSANPRG

SEQ ID NO: 564 - protein, 12 aa, Artificial sequence
  an artificially synthesized sequence
TSTSIRSANPRG

SEQ ID NO: 565 - protein, 12 aa, Artificial sequence
  an artificially synthesized sequence
TSTSKRSANPRG

SEQ ID NO: 566 - protein, 12 aa, Artificial sequence
  an artificially synthesized sequence
TSTSLRSANPRG

SEQ ID NO: 567 - protein, 12 aa, Artificial sequence
  an artificially synthesized sequence
TSTSMRSANPRG

SEQ ID NO: 568 - protein, 12 aa, Artificial sequence
  an artificially synthesized sequence
TSTSNRSANPRG

SEQ ID NO: 569 - protein, 12 aa, Artificial sequence
  an artificially synthesized sequence
TSTSPRSANPRG

SEQ ID NO: 570 - protein, 12 aa, Artificial sequence
  an artificially synthesized sequence
TSTSQRSANPRG

SEQ ID NO: 571 - protein, 12 aa, Artificial sequence
  an artificially synthesized sequence
TSTSRRSANPRG

SEQ ID NO: 572 - protein, 12 aa, Artificial sequence
  an artificially synthesized sequence
TSTSTRSANPRG

SEQ ID NO: 573 - protein, 12 aa, Artificial sequence
  an artificially synthesized sequence
TSTSVRSANPRG

SEQ ID NO: 574 - protein, 12 aa, Artificial sequence
  an artificially synthesized sequence
TSTSWRSANPRG

SEQ ID NO: 575 - protein, 12 aa, Artificial sequence
  an artificially synthesized sequence
TSTSYRSANPRG

SEQ ID NO: 576 - protein, 12 aa, Artificial sequence
  an artificially synthesized sequence
TSTSGRAANPRG

SEQ ID NO: 577 - protein, 12 aa, Artificial sequence
  an artificially synthesized sequence
TSTSGRDANPRG

SEQ ID NO: 578 - protein, 12 aa, Artificial sequence
  an artificially synthesized sequence
TSTSGREANPRG

SEQ ID NO: 579 - protein, 12 aa, Artificial sequence
  an artificially synthesized sequence
TSTSGRGANPRG

SEQ ID NO: 580 - protein, 12 aa, Artificial sequence
  an artificially synthesized sequence
TSTSGRHANPRG

SEQ ID NO: 581 - protein, 12 aa, Artificial sequence
  an artificially synthesized sequence
TSTSGRIANPRG

SEQ ID NO: 582 - protein, 12 aa, Artificial sequence
  an artificially synthesized sequence
TSTSGRKANPRG

SEQ ID NO: 583 - protein, 12 aa, Artificial sequence
  an artificially synthesized sequence
TSTSGRLANPRG

SEQ ID NO: 584 - protein, 12 aa, Artificial sequence
  an artificially synthesized sequence
TSTSGRMANPRG

SEQ ID NO: 585 - protein, 12 aa, Artificial sequence
  an artificially synthesized sequence
TSTSGRNANPRG

SEQ ID NO: 586 - protein, 12 aa, Artificial sequence
  an artificially synthesized sequence
TSTSGRPANPRG

SEQ ID NO: 587 - protein, 12 aa, Artificial sequence
  an artificially synthesized sequence
TSTSGRQANPRG

SEQ ID NO: 588 - protein, 12 aa, Artificial sequence
  an artificially synthesized sequence
TSTSGRRANPRG

SEQ ID NO: 589 - protein, 12 aa, Artificial sequence
  an artificially synthesized sequence
TSTSGRTANPRG

SEQ ID NO: 590 - protein, 12 aa, Artificial sequence
  an artificially synthesized sequence
TSTSGRVANPRG

SEQ ID NO: 591 - protein, 12 aa, Artificial sequence
  an artificially synthesized sequence
TSTSGRWANPRG

SEQ ID NO: 592 - protein, 12 aa, Artificial sequence
  an artificially synthesized sequence
TSTSGRYANPRG

SEQ ID NO: 593 - protein, 12 aa, Artificial sequence
  an artificially synthesized sequence
TSTSGRSENPRG

SEQ ID NO: 594 - protein, 12 aa, Artificial sequence
  an artificially synthesized sequence
TSTSGRSFNPRG

SEQ ID NO: 595 - protein, 12 aa, Artificial sequence
  an artificially synthesized sequence
TSTSGRSKNPRG

SEQ ID NO: 596 - protein, 12 aa, Artificial sequence
  an artificially synthesized sequence
TSTSGRSMNPRG

SEQ ID NO: 597 - protein, 12 aa, Artificial sequence
  an artificially synthesized sequence
TSTSGRSNNPRG

SEQ ID NO: 598 - protein, 12 aa, Artificial sequence
  an artificially synthesized sequence
TSTSGRSPNPRG

SEQ ID NO: 599 - protein, 12 aa, Artificial sequence
  an artificially synthesized sequence
TSTSGRSQNPRG

SEQ ID NO: 600 - protein, 12 aa, Artificial sequence
  an artificially synthesized sequence
TSTSGRSRNPRG

SEQ ID NO: 601 - protein, 12 aa, Artificial sequence
  an artificially synthesized sequence
TSTSGRSSNPRG

SEQ ID NO: 602 - protein, 12 aa, Artificial sequence
  an artificially synthesized sequence
TSTSGRSWNPRG

SEQ ID NO: 603 - protein, 12 aa, Artificial sequence
  an artificially synthesized sequence
TSTSGRSYNPRG

SEQ ID NO: 604 - protein, 12 aa, Artificial sequence
  an artificially synthesized sequence
TSTSGRSAAPRG

SEQ ID NO: 605 - protein, 12 aa, Artificial sequence
  an artificially synthesized sequence
TSTSGRSADPRG

SEQ ID NO: 606 - protein, 12 aa, Artificial sequence
  an artificially synthesized sequence
TSTSGRSAEPRG

SEQ ID NO: 607 - protein, 12 aa, Artificial sequence
  an artificially synthesized sequence
TSTSGRSAFPRG

SEQ ID NO: 608 - protein, 12 aa, Artificial sequence
  an artificially synthesized sequence
TSTSGRSAGPRG

SEQ ID NO: 609 - protein, 12 aa, Artificial sequence
  an artificially synthesized sequence
TSTSGRSAKPRG

SEQ ID NO: 610 - protein, 12 aa, Artificial sequence
  an artificially synthesized sequence
TSTSGRSALPRG

SEQ ID NO: 611 - protein, 12 aa, Artificial sequence
  an artificially synthesized sequence
TSTSGRSAMPRG

SEQ ID NO: 612 - protein, 12 aa, Artificial sequence
  an artificially synthesized sequence
TSTSGRSAPPRG

SEQ ID NO: 613 - protein, 12 aa, Artificial sequence
  an artificially synthesized sequence
TSTSGRSAQPRG

SEQ ID NO: 614 - protein, 12 aa, Artificial sequence
  an artificially synthesized sequence
TSTSGRSAVPRG

SEQ ID NO: 615 - protein, 12 aa, Artificial sequence
  an artificially synthesized sequence
TSTSGRSAWPRG

SEQ ID NO: 616 - protein, 12 aa, Artificial sequence
  an artificially synthesized sequence
TSTSGRSAYPRG

SEQ ID NO: 617 - protein, 12 aa, Artificial sequence
  an artificially synthesized sequence
TSTSGRSANARG

SEQ ID NO: 618 - protein, 12 aa, Artificial sequence
  an artificially synthesized sequence
TSTSGRSANDRG

SEQ ID NO: 619 - protein, 12 aa, Artificial sequence
  an artificially synthesized sequence
TSTSGRSANERG

SEQ ID NO: 620 - protein, 12 aa, Artificial sequence
  an artificially synthesized sequence
TSTSGRSANFRG

SEQ ID NO: 621 - protein, 12 aa, Artificial sequence
  an artificially synthesized sequence
TSTSGRSANGRG

SEQ ID NO: 622 - protein, 12 aa, Artificial sequence
  an artificially synthesized sequence
TSTSGRSANIRG

SEQ ID NO: 623 - protein, 12 aa, Artificial sequence
  an artificially synthesized sequence
TSTSGRSANKRG

SEQ ID NO: 624 - protein, 12 aa, Artificial sequence
  an artificially synthesized sequence
TSTSGRSANNRG

SEQ ID NO: 625 - protein, 12 aa, Artificial sequence
  an artificially synthesized sequence
TSTSGRSANQRG

SEQ ID NO: 626 - protein, 12 aa, Artificial sequence
  an artificially synthesized sequence
TSTSGRSANSRG

SEQ ID NO: 627 - protein, 12 aa, Artificial sequence
  an artificially synthesized sequence
TSTSGRSANTRG

SEQ ID NO: 628 - protein, 12 aa, Artificial sequence
  an artificially synthesized sequence
TSTSGRSANWRG

SEQ ID NO: 629 - protein, 12 aa, Artificial sequence
  an artificially synthesized sequence
TSDSGRSANPRG

SEQ ID NO: 630 - protein, 12 aa, Artificial sequence
  an artificially synthesized sequence
TSISGRSANPRG

SEQ ID NO: 631 - protein, 12 aa, Artificial sequence
  an artificially synthesized sequence
TSSSGRSANPRG

SEQ ID NO: 632 - protein, 12 aa, Artificial sequence
  an artificially synthesized sequence
TSTHGRSANPRG

SEQ ID NO: 633 - protein, 12 aa, Artificial sequence
  an artificially synthesized sequence
TSTKGRSANPRG

SEQ ID NO: 634 - protein, 12 aa, Artificial sequence
  an artificially synthesized sequence
TSTTGRSANPRG

SEQ ID NO: 635 - protein, 12 aa, Artificial sequence
  an artificially synthesized sequence
TSTYGRSANPRG

SEQ ID NO: 636 - protein, 12 aa, Artificial sequence
  an artificially synthesized sequence
TSTSDRSANPRG

SEQ ID NO: 637 - protein, 12 aa, Artificial sequence
  an artificially synthesized sequence
TSTSSRSANPRG

SEQ ID NO: 638 - protein, 12 aa, Artificial sequence
  an artificially synthesized sequence
TSTSGRFANPRG

SEQ ID NO: 639 - protein, 12 aa, Artificial sequence
  an artificially synthesized sequence
TSTSGRSDNPRG

SEQ ID NO: 640 - protein, 12 aa, Artificial sequence
  an artificially synthesized sequence
TSTSGRSHNPRG

SEQ ID NO: 641 - protein, 12 aa, Artificial sequence
  an artificially synthesized sequence
TSTSGRSINPRG

SEQ ID NO: 642 - protein, 12 aa, Artificial sequence
  an artificially synthesized sequence
TSTSGRSLNPRG

SEQ ID NO: 643 - protein, 12 aa, Artificial sequence
  an artificially synthesized sequence
TSTSGRSTNPRG

SEQ ID NO: 644 - protein, 12 aa, Artificial sequence
  an artificially synthesized sequence
TSTSGRSVNPRG

SEQ ID NO: 645 - protein, 12 aa, Artificial sequence
  an artificially synthesized sequence
TSTSGRSAHPRG

SEQ ID NO: 646 - protein, 12 aa, Artificial sequence
  an artificially synthesized sequence
TSTSGRSAIPRG

SEQ ID NO: 647 - protein, 12 aa, Artificial sequence
  an artificially synthesized sequence
TSTSGRSARPRG

SEQ ID NO: 648 - protein, 12 aa, Artificial sequence
  an artificially synthesized sequence
TSTSGRSASPRG

SEQ ID NO: 649 - protein, 12 aa, Artificial sequence
  an artificially synthesized sequence
TSTSGRSATPRG

SEQ ID NO: 650 - protein, 12 aa, Artificial sequence
  an artificially synthesized sequence
TSTSGRSANHRG

SEQ ID NO: 651 - protein, 12 aa, Artificial sequence
  an artificially synthesized sequence
TSTSGRSANLRG

SEQ ID NO: 652 - protein, 12 aa, Artificial sequence
  an artificially synthesized sequence
TSTSGRSANMRG

SEQ ID NO: 653 - protein, 12 aa, Artificial sequence
  an artificially synthesized sequence
TSTSGRSANRRG

SEQ ID NO: 654 - protein, 12 aa, Artificial sequence
  an artificially synthesized sequence
TSTSGRSANVRG

SEQ ID NO: 655 - protein, 12 aa, Artificial sequence
  an artificially synthesized sequence
TSTSGRSANYRG

SEQ ID NO: 656 - protein, 12 aa, Artificial sequence
  an artificially synthesized sequence
TSGSGRSAVPRG

SEQ ID NO: 657 - protein, 12 aa, Artificial sequence
  an artificially synthesized sequence
TSGSGRSAYPRG

SEQ ID NO: 658 - protein, 12 aa, Artificial sequence
  an artificially synthesized sequence
TSGSGRSANQRG

SEQ ID NO: 659 - protein, 12 aa, Artificial sequence
  an artificially synthesized sequence
TSGSGRSANIRG

SEQ ID NO: 660 - protein, 12 aa, Artificial sequence
  an artificially synthesized sequence
TSGSGRSANFRG

SEQ ID NO: 661 - protein, 12 aa, Artificial sequence
  an artificially synthesized sequence
TSGSGRSANSRG

SEQ ID NO: 662 - protein, 12 aa, Artificial sequence
  an artificially synthesized sequence
TSQSGRSAVPRG

SEQ ID NO: 663 - protein, 12 aa, Artificial sequence
  an artificially synthesized sequence
TSQSGRSAYPRG

SEQ ID NO: 664 - protein, 12 aa, Artificial sequence
  an artificially synthesized sequence
TSQSGRSANARG

SEQ ID NO: 665 - protein, 12 aa, Artificial sequence
  an artificially synthesized sequence
TSQSGRSANIRG

SEQ ID NO: 666 - protein, 12 aa, Artificial sequence
  an artificially synthesized sequence
TSQSGRSANFRG

SEQ ID NO: 667 - protein, 12 aa, Artificial sequence
  an artificially synthesized sequence
TSQSGRSANSRG

SEQ ID NO: 668 - protein, 12 aa, Artificial sequence
  an artificially synthesized sequence
TSPSGRSAVPRG

SEQ ID NO: 669 - protein, 12 aa, Artificial sequence
  an artificially synthesized sequence
TSPSGRSANQRG

SEQ ID NO: 670 - protein, 12 aa, Artificial sequence
  an artificially synthesized sequence
TSPSGRSANARG

SEQ ID NO: 671 - protein, 12 aa, Artificial sequence
  an artificially synthesized sequence
TSPSGRSANIRG

SEQ ID NO: 672 - protein, 12 aa, Artificial sequence
  an artificially synthesized sequence
TSPSGRSANFRG

SEQ ID NO: 673 - protein, 12 aa, Artificial sequence
  an artificially synthesized sequence
TSPSGRSANSRG

SEQ ID NO: 674 - protein, 12 aa, Artificial sequence
  an artificially synthesized sequence
TSASGRSAVPRG

SEQ ID NO: 675 - protein, 12 aa, Artificial sequence
  an artificially synthesized sequence
TSASGRSAYPRG

SEQ ID NO: 676 - protein, 12 aa, Artificial sequence
  an artificially synthesized sequence
TSASGRSANQRG

SEQ ID NO: 677 - protein, 12 aa, Artificial sequence
  an artificially synthesized sequence
TSASGRSANARG

SEQ ID NO: 678 - protein, 12 aa, Artificial sequence
  an artificially synthesized sequence
TSASGRSANIRG

SEQ ID NO: 679 - protein, 12 aa, Artificial sequence
  an artificially synthesized sequence
TSASGRSANFRG

SEQ ID NO: 680 - protein, 12 aa, Artificial sequence
  an artificially synthesized sequence
TSASGRSANSRG

SEQ ID NO: 681 - protein, 12 aa, Artificial sequence
  an artificially synthesized sequence
TSYSGRSENPRG

SEQ ID NO: 682 - protein, 12 aa, Artificial sequence
  an artificially synthesized sequence
TSGSGRSENPRG

SEQ ID NO: 683 - protein, 12 aa, Artificial sequence
  an artificially synthesized sequence
TSQSGRSENPRG

SEQ ID NO: 684 - protein, 12 aa, Artificial sequence
  an artificially synthesized sequence
TSPSGRSENPRG

SEQ ID NO: 685 - protein, 12 aa, Artificial sequence
  an artificially synthesized sequence
TSASGRSENPRG

SEQ ID NO: 686 - protein, 12 aa, Artificial sequence
  an artificially synthesized sequence
TSHSGRSENPRG

SEQ ID NO: 687 - protein, 12 aa, Artificial sequence
  an artificially synthesized sequence
TSTSGRSENQRG

SEQ ID NO: 688 - protein, 12 aa, Artificial sequence
  an artificially synthesized sequence
TSTSGRSENARG

SEQ ID NO: 689 - protein, 12 aa, Artificial sequence
  an artificially synthesized sequence
TSTSGRSENIRG

SEQ ID NO: 690 - protein, 12 aa, Artificial sequence
  an artificially synthesized sequence
TSTSGRSENFRG

SEQ ID NO: 691 - protein, 12 aa, Artificial sequence
  an artificially synthesized sequence
TSTSGRSENSRG

SEQ ID NO: 692 - protein, 12 aa, Artificial sequence
  an artificially synthesized sequence
TSYSGRSAEPRG

SEQ ID NO: 693 - protein, 12 aa, Artificial sequence
  an artificially synthesized sequence
TSGSGRSAEPRG

SEQ ID NO: 694 - protein, 12 aa, Artificial sequence
  an artificially synthesized sequence
TSQSGRSAEPRG

SEQ ID NO: 695 - protein, 12 aa, Artificial sequence
  an artificially synthesized sequence
TSPSGRSAEPRG

SEQ ID NO: 696 - protein, 12 aa, Artificial sequence
  an artificially synthesized sequence
TSASGRSAEPRG

SEQ ID NO: 697 - protein, 12 aa, Artificial sequence
  an artificially synthesized sequence
TSHSGRSAEPRG

SEQ ID NO: 698 - protein, 12 aa, Artificial sequence
  an artificially synthesized sequence
TSTSGRSAEQRG

SEQ ID NO: 699 - protein, 12 aa, Artificial sequence
  an artificially synthesized sequence
TSTSGRSAEARG

SEQ ID NO: 700 - protein, 12 aa, Artificial sequence
  an artificially synthesized sequence
TSTSGRSAEIRG

SEQ ID NO: 701 - protein, 12 aa, Artificial sequence
  an artificially synthesized sequence
TSTSGRSAEFRG

SEQ ID NO: 702 - protein, 12 aa, Artificial sequence
  an artificially synthesized sequence
TSTSGRSAESRG

SEQ ID NO: 703 - protein, 12 aa, Artificial sequence
  an artificially synthesized sequence
TSGTGRSANPRG

SEQ ID NO: 704 - protein, 12 aa, Artificial sequence
  an artificially synthesized sequence
TSGKGRSANPRG

SEQ ID NO: 705 - protein, 12 aa, Artificial sequence
  an artificially synthesized sequence
TSGSGRSAIPRG

SEQ ID NO: 706 - protein, 12 aa, Artificial sequence
  an artificially synthesized sequence
TSGSGRSASPRG

SEQ ID NO: 707 - protein, 12 aa, Artificial sequence
  an artificially synthesized sequence
TSGSGRSAHPRG

SEQ ID NO: 708 - protein, 12 aa, Artificial sequence
  an artificially synthesized sequence
TSGSGRSANYRG

SEQ ID NO: 709 - protein, 12 aa, Artificial sequence
  an artificially synthesized sequence
TSGSGRSANVRG

SEQ ID NO: 710 - protein, 12 aa, Artificial sequence
  an artificially synthesized sequence
TSGSGRSANHRG

SEQ ID NO: 711 - protein, 12 aa, Artificial sequence
  an artificially synthesized sequence
TSQTGRSANPRG

SEQ ID NO: 712 - protein, 12 aa, Artificial sequence
  an artificially synthesized sequence
TSQKGRSANPRG

SEQ ID NO: 713 - protein, 12 aa, Artificial sequence
  an artificially synthesized sequence
TSQSGRSAIPRG

SEQ ID NO: 714 - protein, 12 aa, Artificial sequence
  an artificially synthesized sequence
TSQSGRSASPRG

SEQ ID NO: 715 - protein, 12 aa, Artificial sequence
  an artificially synthesized sequence
TSQSGRSAHPRG

SEQ ID NO: 716 - protein, 12 aa, Artificial sequence
  an artificially synthesized sequence
TSQSGRSANYRG

SEQ ID NO: 717 - protein, 12 aa, Artificial sequence
  an artificially synthesized sequence
TSQSGRSANVRG

SEQ ID NO: 718 - protein, 12 aa, Artificial sequence
  an artificially synthesized sequence
TSQSGRSANHRG

SEQ ID NO: 719 - protein, 12 aa, Artificial sequence
  an artificially synthesized sequence
TSPTGRSANPRG

SEQ ID NO: 720 - protein, 12 aa, Artificial sequence
  an artificially synthesized sequence
TSPKGRSANPRG

SEQ ID NO: 721 - protein, 12 aa, Artificial sequence
  an artificially synthesized sequence
TSPSGRSAIPRG

SEQ ID NO: 722 - protein, 12 aa, Artificial sequence
  an artificially synthesized sequence
TSPSGRSATPRG

SEQ ID NO: 723 - protein, 12 aa, Artificial sequence
  an artificially synthesized sequence
TSPSGRSASPRG

SEQ ID NO: 724 - protein, 12 aa, Artificial sequence
  an artificially synthesized sequence
TSPSGRSAHPRG

SEQ ID NO: 725 - protein, 12 aa, Artificial sequence
  an artificially synthesized sequence
TSPSGRSANYRG

SEQ ID NO: 726 - protein, 12 aa, Artificial sequence
  an artificially synthesized sequence
TSPSGRSANVRG

SEQ ID NO: 727 - protein, 12 aa, Artificial sequence
  an artificially synthesized sequence
TSPSGRSANHRG

SEQ ID NO: 728 - protein, 12 aa, Artificial sequence
  an artificially synthesized sequence
TSATGRSANPRG

SEQ ID NO: 729 - protein, 12 aa, Artificial sequence
  an artificially synthesized sequence
TSAKGRSANPRG

SEQ ID NO: 730 - protein, 12 aa, Artificial sequence
  an artificially synthesized sequence
TSASGRSAIPRG

SEQ ID NO: 731 - protein, 12 aa, Artificial sequence
  an artificially synthesized sequence
TSASGRSASPRG

SEQ ID NO: 732 - protein, 12 aa, Artificial sequence
  an artificially synthesized sequence
TSASGRSAHPRG

SEQ ID NO: 733 - protein, 12 aa, Artificial sequence
  an artificially synthesized sequence
TSASGRSANYRG

SEQ ID NO: 734 - protein, 12 aa, Artificial sequence
  an artificially synthesized sequence
TSASGRSANVRG

SEQ ID NO: 735 - protein, 12 aa, Artificial sequence
  an artificially synthesized sequence
TSASGRSANHRG

SEQ ID NO: 736 - protein, 12 aa, Artificial sequence
  an artificially synthesized sequence
TSYTGRSANPRG

SEQ ID NO: 737 - protein, 12 aa, Artificial sequence
  an artificially synthesized sequence
TSYKGRSANPRG

SEQ ID NO: 738 - protein, 12 aa, Artificial sequence
  an artificially synthesized sequence
TSYSGRSAIPRG

SEQ ID NO: 739 - protein, 12 aa, Artificial sequence
  an artificially synthesized sequence
TSYSGRSATPRG

SEQ ID NO: 740 - protein, 12 aa, Artificial sequence
  an artificially synthesized sequence
TSYSGRSASPRG

SEQ ID NO: 741 - protein, 12 aa, Artificial sequence
  an artificially synthesized sequence
TSYSGRSAHPRG

SEQ ID NO: 742 - protein, 12 aa, Artificial sequence
  an artificially synthesized sequence
TSYSGRSANARG

SEQ ID NO: 743 - protein, 12 aa, Artificial sequence
  an artificially synthesized sequence
TSYSGRSANYRG

SEQ ID NO: 744 - protein, 12 aa, Artificial sequence
  an artificially synthesized sequence
TSYSGRSANVRG

SEQ ID NO: 745 - protein, 12 aa, Artificial sequence
  an artificially synthesized sequence
TSYSGRSANHRG

SEQ ID NO: 746 - protein, 12 aa, Artificial sequence
  an artificially synthesized sequence
TSSTGRSANPRG

SEQ ID NO: 747 - protein, 12 aa, Artificial sequence
  an artificially synthesized sequence
TSSKGRSANPRG

SEQ ID NO: 748 - protein, 12 aa, Artificial sequence
  an artificially synthesized sequence
TSSSGRSAVPRG

SEQ ID NO: 749 - protein, 12 aa, Artificial sequence
  an artificially synthesized sequence
TSSSGRSAIPRG

SEQ ID NO: 750 - protein, 12 aa, Artificial sequence
  an artificially synthesized sequence
TSSSGRSASPRG

SEQ ID NO: 751 - protein, 12 aa, Artificial sequence
  an artificially synthesized sequence
TSSSGRSAHPRG

SEQ ID NO: 752 - protein, 12 aa, Artificial sequence
  an artificially synthesized sequence
TSSSGRSANARG

SEQ ID NO: 753 - protein, 12 aa, Artificial sequence
  an artificially synthesized sequence
TSSSGRSANFRG

SEQ ID NO: 754 - protein, 12 aa, Artificial sequence
  an artificially synthesized sequence
TSSSGRSANYRG

SEQ ID NO: 755 - protein, 12 aa, Artificial sequence
  an artificially synthesized sequence
TSSSGRSANVRG

SEQ ID NO: 756 - protein, 12 aa, Artificial sequence
  an artificially synthesized sequence
TSSSGRSANHRG

SEQ ID NO: 757 - protein, 12 aa, Artificial sequence
  an artificially synthesized sequence
TSITGRSANPRG

SEQ ID NO: 758 - protein, 12 aa, Artificial sequence
  an artificially synthesized sequence
TSIKGRSANPRG

SEQ ID NO: 759 - protein, 12 aa, Artificial sequence
  an artificially synthesized sequence
TSISGRSAVPRG

SEQ ID NO: 760 - protein, 12 aa, Artificial sequence
  an artificially synthesized sequence
TSISGRSAIPRG

SEQ ID NO: 761 - protein, 12 aa, Artificial sequence
  an artificially synthesized sequence
TSISGRSATPRG

SEQ ID NO: 762 - protein, 12 aa, Artificial sequence
  an artificially synthesized sequence
TSISGRSASPRG

SEQ ID NO: 763 - protein, 12 aa, Artificial sequence
  an artificially synthesized sequence
TSISGRSAHPRG

SEQ ID NO: 764 - protein, 12 aa, Artificial sequence
  an artificially synthesized sequence
TSISGRSANARG

SEQ ID NO: 765 - protein, 12 aa, Artificial sequence
  an artificially synthesized sequence
TSISGRSANFRG

SEQ ID NO: 766 - protein, 12 aa, Artificial sequence
  an artificially synthesized sequence
TSISGRSANYRG

SEQ ID NO: 767 - protein, 12 aa, Artificial sequence
  an artificially synthesized sequence
TSISGRSANVRG

SEQ ID NO: 768 - protein, 12 aa, Artificial sequence
  an artificially synthesized sequence
TSISGRSANHRG

SEQ ID NO: 769 - protein, 12 aa, Artificial sequence
  an artificially synthesized sequence
TSTTGRSAVPRG

SEQ ID NO: 770 - protein, 12 aa, Artificial sequence
  an artificially synthesized sequence
TSTTGRSAIPRG

SEQ ID NO: 771 - protein, 12 aa, Artificial sequence
  an artificially synthesized sequence
TSTTGRSATPRG

SEQ ID NO: 772 - protein, 12 aa, Artificial sequence
  an artificially synthesized sequence
TSTTGRSAHPRG

SEQ ID NO: 773 - protein, 12 aa, Artificial sequence
  an artificially synthesized sequence
TSTTGRSANARG

SEQ ID NO: 774 - protein, 12 aa, Artificial sequence
  an artificially synthesized sequence
TSTTGRSANFRG

SEQ ID NO: 775 - protein, 12 aa, Artificial sequence
  an artificially synthesized sequence
TSTTGRSANYRG

SEQ ID NO: 776 - protein, 12 aa, Artificial sequence
  an artificially synthesized sequence
TSTTGRSANVRG

SEQ ID NO: 777 - protein, 12 aa, Artificial sequence
  an artificially synthesized sequence
TSTTGRSANHRG

SEQ ID NO: 778 - protein, 12 aa, Artificial sequence
  an artificially synthesized sequence
TSTKGRSAVPRG

SEQ ID NO: 779 - protein, 12 aa, Artificial sequence
  an artificially synthesized sequence
TSTKGRSAIPRG

SEQ ID NO: 780 - protein, 12 aa, Artificial sequence
  an artificially synthesized sequence
TSTKGRSATPRG

SEQ ID NO: 781 - protein, 12 aa, Artificial sequence
  an artificially synthesized sequence
TSTKGRSASPRG

SEQ ID NO: 782 - protein, 12 aa, Artificial sequence
  an artificially synthesized sequence
TSTKGRSAHPRG

SEQ ID NO: 783 - protein, 12 aa, Artificial sequence
  an artificially synthesized sequence
TSTKGRSANARG

SEQ ID NO: 784 - protein, 12 aa, Artificial sequence
  an artificially synthesized sequence
TSTKGRSANFRG

SEQ ID NO: 785 - protein, 12 aa, Artificial sequence
  an artificially synthesized sequence
TSTKGRSANYRG

SEQ ID NO: 786 - protein, 12 aa, Artificial sequence
  an artificially synthesized sequence
TSTKGRSANVRG

SEQ ID NO: 787 - protein, 12 aa, Artificial sequence
  an artificially synthesized sequence
TSTKGRSANHRG

SEQ ID NO: 788 - protein, 12 aa, Artificial sequence
  an artificially synthesized sequence
TSTSGRSAVYRG

SEQ ID NO: 789 - protein, 12 aa, Artificial sequence
  an artificially synthesized sequence
TSTSGRSAVVRG

SEQ ID NO: 790 - protein, 12 aa, Artificial sequence
  an artificially synthesized sequence
TSTSGRSAVHRG

SEQ ID NO: 791 - protein, 12 aa, Artificial sequence
  an artificially synthesized sequence
TSTSGRSAIYRG

SEQ ID NO: 792 - protein, 12 aa, Artificial sequence
  an artificially synthesized sequence
TSTSGRSAIVRG

SEQ ID NO: 793 - protein, 12 aa, Artificial sequence
  an artificially synthesized sequence
TSTSGRSAIHRG

SEQ ID NO: 794 - protein, 12 aa, Artificial sequence
  an artificially synthesized sequence
TSTSGRSASYRG

SEQ ID NO: 795 - protein, 12 aa, Artificial sequence
  an artificially synthesized sequence
TSTSGRSASVRG

SEQ ID NO: 796 - protein, 12 aa, Artificial sequence
  an artificially synthesized sequence
TSTSGRSASHRG

SEQ ID NO: 797 - protein, 12 aa, Artificial sequence
  an artificially synthesized sequence
TSTSGRSAHYRG

SEQ ID NO: 798 - protein, 12 aa, Artificial sequence
  an artificially synthesized sequence
TSTSGRSAHVRG

SEQ ID NO: 799 - protein, 12 aa, Artificial sequence
  an artificially synthesized sequence
TSTSGRSAHHRG

SEQ ID NO: 800 - protein, 12 aa, Artificial sequence
  an artificially synthesized sequence
TSPSGRSEVPRG

SEQ ID NO: 801 - protein, 12 aa, Artificial sequence
  an artificially synthesized sequence
TSPSGRSAEPRG

SEQ ID NO: 802 - protein, 12 aa, Artificial sequence
  an artificially synthesized sequence
TSPSGRSAGPRG

SEQ ID NO: 803 - protein, 12 aa, Artificial sequence
  an artificially synthesized sequence
TSASGRSENARG

SEQ ID NO: 804 - protein, 12 aa, Artificial sequence
  an artificially synthesized sequence
TSASGRSAEARG

SEQ ID NO: 805 - protein, 12 aa, Artificial sequence
  an artificially synthesized sequence
TSASGRSAGARG

SEQ ID NO: 806 - protein, 12 aa, Artificial sequence
  an artificially synthesized sequence
TSGTGRSATPRG

SEQ ID NO: 807 - protein, 12 aa, Artificial sequence
  an artificially synthesized sequence
TSGSGRSATYRG

SEQ ID NO: 808 - protein, 12 aa, Artificial sequence
  an artificially synthesized sequence
TSGSGRSATVRG

SEQ ID NO: 809 - protein, 12 aa, Artificial sequence
  an artificially synthesized sequence
TSGSGRSATHRG

SEQ ID NO: 810 - protein, 12 aa, Artificial sequence
  an artificially synthesized sequence
TSGTGRSATYRG

SEQ ID NO: 811 - protein, 12 aa, Artificial sequence
  an artificially synthesized sequence
TSGTGRSATVRG

SEQ ID NO: 812 - protein, 12 aa, Artificial sequence
  an artificially synthesized sequence
TSGTGRSATHRG

SEQ ID NO: 813 - protein, 12 aa, Artificial sequence
  an artificially synthesized sequence
TSGSGRSETPRG

SEQ ID NO: 814 - protein, 12 aa, Artificial sequence
  an artificially synthesized sequence
TSGTGRSETPRG

SEQ ID NO: 815 - protein, 12 aa, Artificial sequence
  an artificially synthesized sequence
TSGSGRSETYRG

SEQ ID NO: 816 - protein, 12 aa, Artificial sequence
  an artificially synthesized sequence
TSGSGRSETVRG

SEQ ID NO: 817 - protein, 12 aa, Artificial sequence
  an artificially synthesized sequence
TSGSGRSETHRG

SEQ ID NO: 818 - protein, 12 aa, Artificial sequence
  an artificially synthesized sequence
TSYTGRSAVPRG

SEQ ID NO: 819 - protein, 12 aa, Artificial sequence
  an artificially synthesized sequence
TSYSGRSAVYRG

SEQ ID NO: 820 - protein, 12 aa, Artificial sequence
  an artificially synthesized sequence
TSYSGRSAVVRG

SEQ ID NO: 821 - protein, 12 aa, Artificial sequence
  an artificially synthesized sequence
TSYSGRSAVHRG

SEQ ID NO: 822 - protein, 12 aa, Artificial sequence
  an artificially synthesized sequence
TSYTGRSAVYRG

SEQ ID NO: 823 - protein, 12 aa, Artificial sequence
  an artificially synthesized sequence
TSYTGRSAVVRG

SEQ ID NO: 824 - protein, 12 aa, Artificial sequence
  an artificially synthesized sequence
TSYTGRSAVHRG

SEQ ID NO: 825 - protein, 12 aa, Artificial sequence
  an artificially synthesized sequence
TSYSGRSEVPRG

SEQ ID NO: 826 - protein, 12 aa, Artificial sequence
  an artificially synthesized sequence
TSYTGRSEVPRG

SEQ ID NO: 827 - protein, 12 aa, Artificial sequence
  an artificially synthesized sequence
TSYSGRSEVYRG

SEQ ID NO: 828 - protein, 12 aa, Artificial sequence
  an artificially synthesized sequence
TSYSGRSEVVRG

SEQ ID NO: 829 - protein, 12 aa, Artificial sequence
  an artificially synthesized sequence
TSYSGRSEVHRG

SEQ ID NO: 830 - protein, 12 aa, Artificial sequence
  an artificially synthesized sequence
TSYTGRSAVPGG

SEQ ID NO: 831 - protein, 12 aa, Artificial sequence
  an artificially synthesized sequence
TSYSGRSAVYGG

SEQ ID NO: 832 - protein, 12 aa, Artificial sequence
  an artificially synthesized sequence
TSYSGRSAVVGG

SEQ ID NO: 833 - protein, 12 aa, Artificial sequence
  an artificially synthesized sequence
TSYSGRSAVHGG

SEQ ID NO: 834 - protein, 12 aa, Artificial sequence
  an artificially synthesized sequence
TSYTGRSAVYGG

SEQ ID NO: 835 - protein, 12 aa, Artificial sequence
  an artificially synthesized sequence
TSYTGRSAVVGG

SEQ ID NO: 836 - protein, 12 aa, Artificial sequence
  an artificially synthesized sequence
TSYTGRSAVHGG

SEQ ID NO: 837 - protein, 8 aa, Artificial sequence
  an artificially synthesized sequence
ASGRSANP

SEQ ID NO: 838 - protein, 8 aa, Artificial sequence
  an artificially synthesized sequence
ESGRSANP

SEQ ID NO: 839 - protein, 8 aa, Artificial sequence
  an artificially synthesized sequence
FSGRSANP

SEQ ID NO: 840 - protein, 8 aa, Artificial sequence
  an artificially synthesized sequence
GSGRSANP

SEQ ID NO: 841 - protein, 8 aa, Artificial sequence
  an artificially synthesized sequence
HSGRSANP

SEQ ID NO: 842 - protein, 8 aa, Artificial sequence
  an artificially synthesized sequence
KSGRSANP

SEQ ID NO: 843 - protein, 8 aa, Artificial sequence
  an artificially synthesized sequence
MSGRSANP

SEQ ID NO: 844 - protein, 8 aa, Artificial sequence
  an artificially synthesized sequence
NSGRSANP

SEQ ID NO: 845 - protein, 8 aa, Artificial sequence
  an artificially synthesized sequence
PSGRSANP

SEQ ID NO: 846 - protein, 8 aa, Artificial sequence
  an artificially synthesized sequence
QSGRSANP

SEQ ID NO: 847 - protein, 8 aa, Artificial sequence
  an artificially synthesized sequence
WSGRSANP

SEQ ID NO: 848 - protein, 8 aa, Artificial sequence
  an artificially synthesized sequence
YSGRSANP

SEQ ID NO: 849 - protein, 8 aa, Artificial sequence
  an artificially synthesized sequence
TAGRSANP

SEQ ID NO: 850 - protein, 8 aa, Artificial sequence
  an artificially synthesized sequence
TDGRSANP

SEQ ID NO: 851 - protein, 8 aa, Artificial sequence
  an artificially synthesized sequence
TEGRSANP

SEQ ID NO: 852 - protein, 8 aa, Artificial sequence
  an artificially synthesized sequence
TFGRSANP

SEQ ID NO: 853 - protein, 8 aa, Artificial sequence
  an artificially synthesized sequence
TLGRSANP

SEQ ID NO: 854 - protein, 8 aa, Artificial sequence
  an artificially synthesized sequence
TMGRSANP

SEQ ID NO: 855 - protein, 8 aa, Artificial sequence
  an artificially synthesized sequence
TPGRSANP

SEQ ID NO: 856 - protein, 8 aa, Artificial sequence
  an artificially synthesized sequence
TQGRSANP

SEQ ID NO: 857 - protein, 8 aa, Artificial sequence
  an artificially synthesized sequence
TVGRSANP

SEQ ID NO: 858 - protein, 8 aa, Artificial sequence
  an artificially synthesized sequence
TWGRSANP

SEQ ID NO: 859 - protein, 8 aa, Artificial sequence
  an artificially synthesized sequence
TSARSANP

SEQ ID NO: 860 - protein, 8 aa, Artificial sequence
  an artificially synthesized sequence
TSERSANP

SEQ ID NO: 861 - protein, 8 aa, Artificial sequence
  an artificially synthesized sequence
TSFRSANP

SEQ ID NO: 862 - protein, 8 aa, Artificial sequence
  an artificially synthesized sequence
TSHRSANP

SEQ ID NO: 863 - protein, 8 aa, Artificial sequence
  an artificially synthesized sequence
TSIRSANP

SEQ ID NO: 864 - protein, 8 aa, Artificial sequence
  an artificially synthesized sequence
TSKRSANP

SEQ ID NO: 865 - protein, 8 aa, Artificial sequence
  an artificially synthesized sequence
TSLRSANP

SEQ ID NO: 866 - protein, 8 aa, Artificial sequence
  an artificially synthesized sequence
TSMRSANP

SEQ ID NO: 867 - protein, 8 aa, Artificial sequence
  an artificially synthesized sequence
TSNRSANP

SEQ ID NO: 868 - protein, 8 aa, Artificial sequence
  an artificially synthesized sequence
TSPRSANP

SEQ ID NO: 869 - protein, 8 aa, Artificial sequence
  an artificially synthesized sequence
TSQRSANP

SEQ ID NO: 870 - protein, 8 aa, Artificial sequence
  an artificially synthesized sequence
TSRRSANP

SEQ ID NO: 871 - protein, 8 aa, Artificial sequence
  an artificially synthesized sequence
TSTRSANP

SEQ ID NO: 872 - protein, 8 aa, Artificial sequence
  an artificially synthesized sequence
TSVRSANP

SEQ ID NO: 873 - protein, 8 aa, Artificial sequence
  an artificially synthesized sequence
TSWRSANP

SEQ ID NO: 874 - protein, 8 aa, Artificial sequence
  an artificially synthesized sequence
TSYRSANP

SEQ ID NO: 875 - protein, 8 aa, Artificial sequence
  an artificially synthesized sequence
TSGRAANP

SEQ ID NO: 876 - protein, 8 aa, Artificial sequence
  an artificially synthesized sequence
TSGRDANP

SEQ ID NO: 877 - protein, 8 aa, Artificial sequence
  an artificially synthesized sequence
TSGREANP

SEQ ID NO: 878 - protein, 8 aa, Artificial sequence
  an artificially synthesized sequence
TSGRGANP

SEQ ID NO: 879 - protein, 8 aa, Artificial sequence
  an artificially synthesized sequence
TSGRHANP

SEQ ID NO: 880 - protein, 8 aa, Artificial sequence
  an artificially synthesized sequence
TSGRIANP

SEQ ID NO: 881 - protein, 8 aa, Artificial sequence
  an artificially synthesized sequence
TSGRKANP

SEQ ID NO: 882 - protein, 8 aa, Artificial sequence
  an artificially synthesized sequence
TSGRLANP

SEQ ID NO: 883 - protein, 8 aa, Artificial sequence
  an artificially synthesized sequence
TSGRMANP

SEQ ID NO: 884 - protein, 8 aa, Artificial sequence
  an artificially synthesized sequence
TSGRNANP

SEQ ID NO: 885 - protein, 8 aa, Artificial sequence
  an artificially synthesized sequence
TSGRPANP

SEQ ID NO: 886 - protein, 8 aa, Artificial sequence
  an artificially synthesized sequence
TSGRQANP

SEQ ID NO: 887 - protein, 8 aa, Artificial sequence
  an artificially synthesized sequence
TSGRRANP

SEQ ID NO: 888 - protein, 8 aa, Artificial sequence
  an artificially synthesized sequence
TSGRTANP

SEQ ID NO: 889 - protein, 8 aa, Artificial sequence
  an artificially synthesized sequence
TSGRVANP

SEQ ID NO: 890 - protein, 8 aa, Artificial sequence
  an artificially synthesized sequence
TSGRWANP

SEQ ID NO: 891 - protein, 8 aa, Artificial sequence
  an artificially synthesized sequence
TSGRYANP

SEQ ID NO: 892 - protein, 8 aa, Artificial sequence
  an artificially synthesized sequence
TSGRSENP

SEQ ID NO: 893 - protein, 8 aa, Artificial sequence
  an artificially synthesized sequence
TSGRSFNP

SEQ ID NO: 894 - protein, 8 aa, Artificial sequence
  an artificially synthesized sequence
TSGRSKNP

SEQ ID NO: 895 - protein, 8 aa, Artificial sequence
  an artificially synthesized sequence
TSGRSMNP

SEQ ID NO: 896 - protein, 8 aa, Artificial sequence
  an artificially synthesized sequence
TSGRSNNP

SEQ ID NO: 897 - protein, 8 aa, Artificial sequence
  an artificially synthesized sequence
TSGRSPNP

SEQ ID NO: 898 - protein, 8 aa, Artificial sequence
  an artificially synthesized sequence
TSGRSQNP

SEQ ID NO: 899 - protein, 8 aa, Artificial sequence
  an artificially synthesized sequence
TSGRSRNP

SEQ ID NO: 900 - protein, 8 aa, Artificial sequence
  an artificially synthesized sequence
TSGRSSNP

SEQ ID NO: 901 - protein, 8 aa, Artificial sequence
  an artificially synthesized sequence
TSGRSWNP

SEQ ID NO: 902 - protein, 8 aa, Artificial sequence
  an artificially synthesized sequence
TSGRSYNP

SEQ ID NO: 903 - protein, 8 aa, Artificial sequence
  an artificially synthesized sequence
TSGRSAAP

SEQ ID NO: 904 - protein, 8 aa, Artificial sequence
  an artificially synthesized sequence
TSGRSADP

SEQ ID NO: 905 - protein, 8 aa, Artificial sequence
  an artificially synthesized sequence
TSGRSAEP

SEQ ID NO: 906 - protein, 8 aa, Artificial sequence
  an artificially synthesized sequence
TSGRSAFP

SEQ ID NO: 907 - protein, 8 aa, Artificial sequence
  an artificially synthesized sequence
TSGRSAGP

SEQ ID NO: 908 - protein, 8 aa, Artificial sequence
  an artificially synthesized sequence
TSGRSAKP

SEQ ID NO: 909 - protein, 8 aa, Artificial sequence
  an artificially synthesized sequence
TSGRSALP

SEQ ID NO: 910 - protein, 8 aa, Artificial sequence
  an artificially synthesized sequence
TSGRSAMP

SEQ ID NO: 911 - protein, 8 aa, Artificial sequence
  an artificially synthesized sequence
TSGRSAPP

SEQ ID NO: 912 - protein, 8 aa, Artificial sequence
  an artificially synthesized sequence
TSGRSAQP

SEQ ID NO: 913 - protein, 8 aa, Artificial sequence
  an artificially synthesized sequence
TSGRSAVP

SEQ ID NO: 914 - protein, 8 aa, Artificial sequence
  an artificially synthesized sequence
TSGRSAWP

SEQ ID NO: 915 - protein, 8 aa, Artificial sequence
  an artificially synthesized sequence
TSGRSAYP

SEQ ID NO: 916 - protein, 8 aa, Artificial sequence
  an artificially synthesized sequence
TSGRSANA

SEQ ID NO: 917 - protein, 8 aa, Artificial sequence
  an artificially synthesized sequence
TSGRSAND

SEQ ID NO: 918 - protein, 8 aa, Artificial sequence
  an artificially synthesized sequence
TSGRSANE

SEQ ID NO: 919 - protein, 8 aa, Artificial sequence
  an artificially synthesized sequence
TSGRSANF

SEQ ID NO: 920 - protein, 8 aa, Artificial sequence
  an artificially synthesized sequence
TSGRSANG

SEQ ID NO: 921 - protein, 8 aa, Artificial sequence
  an artificially synthesized sequence
TSGRSANI

SEQ ID NO: 922 - protein, 8 aa, Artificial sequence
  an artificially synthesized sequence
TSGRSANK

SEQ ID NO: 923 - protein, 8 aa, Artificial sequence
  an artificially synthesized sequence
TSGRSANN

SEQ ID NO: 924 - protein, 8 aa, Artificial sequence
  an artificially synthesized sequence
TSGRSANQ

SEQ ID NO: 925 - protein, 8 aa, Artificial sequence
  an artificially synthesized sequence
TSGRSANS

SEQ ID NO: 926 - protein, 8 aa, Artificial sequence
  an artificially synthesized sequence
TSGRSANT

SEQ ID NO: 927 - protein, 8 aa, Artificial sequence
  an artificially synthesized sequence
TSGRSANW

SEQ ID NO: 928 - protein, 8 aa, Artificial sequence
  an artificially synthesized sequence
DSGRSANP

SEQ ID NO: 929 - protein, 8 aa, Artificial sequence
  an artificially synthesized sequence
ISGRSANP

SEQ ID NO: 930 - protein, 8 aa, Artificial sequence
  an artificially synthesized sequence
SSGRSANP

SEQ ID NO: 931 - protein, 8 aa, Artificial sequence
  an artificially synthesized sequence
THGRSANP

SEQ ID NO: 932 - protein, 8 aa, Artificial sequence
  an artificially synthesized sequence
TKGRSANP

SEQ ID NO: 933 - protein, 8 aa, Artificial sequence
  an artificially synthesized sequence
TTGRSANP

SEQ ID NO: 934 - protein, 8 aa, Artificial sequence
  an artificially synthesized sequence
TYGRSANP

SEQ ID NO: 935 - protein, 8 aa, Artificial sequence
  an artificially synthesized sequence
TSDRSANP

SEQ ID NO: 936 - protein, 8 aa, Artificial sequence
  an artificially synthesized sequence
TSSRSANP

SEQ ID NO: 937 - protein, 8 aa, Artificial sequence
  an artificially synthesized sequence
TSGRFANP

SEQ ID NO: 938 - protein, 8 aa, Artificial sequence
  an artificially synthesized sequence
TSGRSDNP

SEQ ID NO: 939 - protein, 8 aa, Artificial sequence
  an artificially synthesized sequence
TSGRSHNP

SEQ ID NO: 940 - protein, 8 aa, Artificial sequence
  an artificially synthesized sequence
TSGRSINP

SEQ ID NO: 941 - protein, 8 aa, Artificial sequence
  an artificially synthesized sequence
TSGRSLNP

SEQ ID NO: 942 - protein, 8 aa, Artificial sequence
  an artificially synthesized sequence
TSGRSTNP

SEQ ID NO: 943 - protein, 8 aa, Artificial sequence
  an artificially synthesized sequence
TSGRSVNP

SEQ ID NO: 944 - protein, 8 aa, Artificial sequence
  an artificially synthesized sequence
TSGRSAHP

SEQ ID NO: 945 - protein, 8 aa, Artificial sequence
  an artificially synthesized sequence
TSGRSAIP

SEQ ID NO: 946 - protein, 8 aa, Artificial sequence
  an artificially synthesized sequence
TSGRSARP

SEQ ID NO: 947 - protein, 8 aa, Artificial sequence
  an artificially synthesized sequence
TSGRSASP

SEQ ID NO: 948 - protein, 8 aa, Artificial sequence
  an artificially synthesized sequence
TSGRSATP

SEQ ID NO: 949 - protein, 8 aa, Artificial sequence
  an artificially synthesized sequence
TSGRSANH

SEQ ID NO: 950 - protein, 8 aa, Artificial sequence
  an artificially synthesized sequence
TSGRSANL

SEQ ID NO: 951 - protein, 8 aa, Artificial sequence
  an artificially synthesized sequence
TSGRSANM

SEQ ID NO: 952 - protein, 8 aa, Artificial sequence
  an artificially synthesized sequence
TSGRSANR

SEQ ID NO: 953 - protein, 8 aa, Artificial sequence
  an artificially synthesized sequence
TSGRSANV

SEQ ID NO: 954 - protein, 8 aa, Artificial sequence
  an artificially synthesized sequence
TSGRSANY

SEQ ID NO: 955 - protein, 8 aa, Artificial sequence
  an artificially synthesized sequence
GSGRSAVP

SEQ ID NO: 956 - protein, 8 aa, Artificial sequence
  an artificially synthesized sequence
GSGRSAYP

SEQ ID NO: 957 - protein, 8 aa, Artificial sequence
  an artificially synthesized sequence
GSGRSANQ

SEQ ID NO: 958 - protein, 8 aa, Artificial sequence
  an artificially synthesized sequence
GSGRSANA

SEQ ID NO: 959 - protein, 8 aa, Artificial sequence
  an artificially synthesized sequence
GSGRSANI

SEQ ID NO: 960 - protein, 8 aa, Artificial sequence
  an artificially synthesized sequence
GSGRSANF

SEQ ID NO: 961 - protein, 8 aa, Artificial sequence
  an artificially synthesized sequence
GSGRSANS

SEQ ID NO: 962 - protein, 8 aa, Artificial sequence
  an artificially synthesized sequence
QSGRSAVP

SEQ ID NO: 963 - protein, 8 aa, Artificial sequence
  an artificially synthesized sequence
QSGRSAYP

SEQ ID NO: 964 - protein, 8 aa, Artificial sequence
  an artificially synthesized sequence
QSGRSANQ

SEQ ID NO: 965 - protein, 8 aa, Artificial sequence
  an artificially synthesized sequence
QSGRSANA

SEQ ID NO: 966 - protein, 8 aa, Artificial sequence
  an artificially synthesized sequence
QSGRSANI

SEQ ID NO: 967 - protein, 8 aa, Artificial sequence
  an artificially synthesized sequence
QSGRSANF

SEQ ID NO: 968 - protein, 8 aa, Artificial sequence
  an artificially synthesized sequence
QSGRSANS

SEQ ID NO: 969 - protein, 8 aa, Artificial sequence
  an artificially synthesized sequence
PSGRSAVP

SEQ ID NO: 970 - protein, 8 aa, Artificial sequence
  an artificially synthesized sequence
PSGRSAYP

SEQ ID NO: 971 - protein, 8 aa, Artificial sequence
  an artificially synthesized sequence
PSGRSANQ

SEQ ID NO: 972 - protein, 8 aa, Artificial sequence
  an artificially synthesized sequence
PSGRSANA

SEQ ID NO: 973 - protein, 8 aa, Artificial sequence
  an artificially synthesized sequence
PSGRSANI

SEQ ID NO: 974 - protein, 8 aa, Artificial sequence
  an artificially synthesized sequence
PSGRSANF

SEQ ID NO: 975 - protein, 8 aa, Artificial sequence
  an artificially synthesized sequence
PSGRSANS

SEQ ID NO: 976 - protein, 8 aa, Artificial sequence
  an artificially synthesized sequence
ASGRSAVP

SEQ ID NO: 977 - protein, 8 aa, Artificial sequence
  an artificially synthesized sequence
ASGRSAYP

SEQ ID NO: 978 - protein, 8 aa, Artificial sequence
  an artificially synthesized sequence
ASGRSANQ

SEQ ID NO: 979 - protein, 8 aa, Artificial sequence
  an artificially synthesized sequence
ASGRSANA

SEQ ID NO: 980 - protein, 8 aa, Artificial sequence
  an artificially synthesized sequence
ASGRSANI

SEQ ID NO: 981 - protein, 8 aa, Artificial sequence
  an artificially synthesized sequence
ASGRSANF

SEQ ID NO: 982 - protein, 8 aa, Artificial sequence
  an artificially synthesized sequence
ASGRSANS

SEQ ID NO: 983 - protein, 8 aa, Artificial sequence
  an artificially synthesized sequence
YSGRSENP

SEQ ID NO: 984 - protein, 8 aa, Artificial sequence
  an artificially synthesized sequence
GSGRSENP

SEQ ID NO: 985 - protein, 8 aa, Artificial sequence
  an artificially synthesized sequence
QSGRSENP

SEQ ID NO: 986 - protein, 8 aa, Artificial sequence
  an artificially synthesized sequence
PSGRSENP

SEQ ID NO: 987 - protein, 8 aa, Artificial sequence
  an artificially synthesized sequence
ASGRSENP

SEQ ID NO: 988 - protein, 8 aa, Artificial sequence
  an artificially synthesized sequence
HSGRSENP

SEQ ID NO: 989 - protein, 8 aa, Artificial sequence
  an artificially synthesized sequence
TSGRSENQ

SEQ ID NO: 990 - protein, 8 aa, Artificial sequence
  an artificially synthesized sequence
TSGRSENA

SEQ ID NO: 991 - protein, 8 aa, Artificial sequence
  an artificially synthesized sequence
TSGRSENI

SEQ ID NO: 992 - protein, 8 aa, Artificial sequence
  an artificially synthesized sequence
TSGRSENF

SEQ ID NO: 993 - protein, 8 aa, Artificial sequence
  an artificially synthesized sequence
TSGRSENS

SEQ ID NO: 994 - protein, 8 aa, Artificial sequence
  an artificially synthesized sequence
YSGRSAEP

SEQ ID NO: 995 - protein, 8 aa, Artificial sequence
  an artificially synthesized sequence
GSGRSAEP

SEQ ID NO: 996 - protein, 8 aa, Artificial sequence
  an artificially synthesized sequence
QSGRSAEP

SEQ ID NO: 997 - protein, 8 aa, Artificial sequence
  an artificially synthesized sequence
PSGRSAEP

SEQ ID NO: 998 - protein, 8 aa, Artificial sequence
  an artificially synthesized sequence
ASGRSAEP

SEQ ID NO: 999 - protein, 8 aa, Artificial sequence
  an artificially synthesized sequence
HSGRSAEP

SEQ ID NO: 1000 - protein, 8 aa, Artificial sequence
  an artificially synthesized sequence
TSGRSAEQ

SEQ ID NO: 1001 - protein, 8 aa, Artificial sequence
  an artificially synthesized sequence
TSGRSAEA

SEQ ID NO: 1002 - protein, 8 aa, Artificial sequence
  an artificially synthesized sequence
TSGRSAEI

SEQ ID NO: 1003 - protein, 8 aa, Artificial sequence
  an artificially synthesized sequence
TSGRSAEF

SEQ ID NO: 1004 - protein, 8 aa, Artificial sequence
  an artificially synthesized sequence
TSGRSAES

SEQ ID NO: 1005 - protein, 8 aa, Artificial sequence
  an artificially synthesized sequence
GTGRSANP

SEQ ID NO: 1006 - protein, 8 aa, Artificial sequence
  an artificially synthesized sequence
GKGRSANP

SEQ ID NO: 1007 - protein, 8 aa, Artificial sequence
  an artificially synthesized sequence
GSGRSAIP

SEQ ID NO: 1008 - protein, 8 aa, Artificial sequence
  an artificially synthesized sequence
GSGRSATP

SEQ ID NO: 1009 - protein, 8 aa, Artificial sequence
  an artificially synthesized sequence
GSGRSASP

SEQ ID NO: 1010 - protein, 8 aa, Artificial sequence
  an artificially synthesized sequence
GSGRSAHP

SEQ ID NO: 1011 - protein, 8 aa, Artificial sequence
  an artificially synthesized sequence
GSGRSANY

SEQ ID NO: 1012 - protein, 8 aa, Artificial sequence
  an artificially synthesized sequence
GSGRSANV

SEQ ID NO: 1013 - protein, 8 aa, Artificial sequence
  an artificially synthesized sequence
GSGRSANH

SEQ ID NO: 1014 - protein, 8 aa, Artificial sequence
  an artificially synthesized sequence
QTGRSANP

SEQ ID NO: 1015 - protein, 8 aa, Artificial sequence
  an artificially synthesized sequence
QKGRSANP

SEQ ID NO: 1016 - protein, 8 aa, Artificial sequence
  an artificially synthesized sequence
QSGRSAIP

SEQ ID NO: 1017 - protein, 8 aa, Artificial sequence
  an artificially synthesized sequence
QSGRSATP

SEQ ID NO: 1018 - protein, 8 aa, Artificial sequence
  an artificially synthesized sequence
QSGRSASP

SEQ ID NO: 1019 - protein, 8 aa, Artificial sequence
  an artificially synthesized sequence
QSGRSAHP

SEQ ID NO: 1020 - protein, 8 aa, Artificial sequence
  an artificially synthesized sequence
QSGRSANY

SEQ ID NO: 1021 - protein, 8 aa, Artificial sequence
  an artificially synthesized sequence
QSGRSANV

SEQ ID NO: 1022 - protein, 8 aa, Artificial sequence
  an artificially synthesized sequence
QSGRSANH

SEQ ID NO: 1023 - protein, 8 aa, Artificial sequence
  an artificially synthesized sequence
PTGRSANP

SEQ ID NO: 1024 - protein, 8 aa, Artificial sequence
  an artificially synthesized sequence
PKGRSANP

SEQ ID NO: 1025 - protein, 8 aa, Artificial sequence
  an artificially synthesized sequence
PSGRSAIP

SEQ ID NO: 1026 - protein, 8 aa, Artificial sequence
  an artificially synthesized sequence
PSGRSATP

SEQ ID NO: 1027 - protein, 8 aa, Artificial sequence
  an artificially synthesized sequence
PSGRSASP

SEQ ID NO: 1028 - protein, 8 aa, Artificial sequence
  an artificially synthesized sequence
PSGRSAHP

SEQ ID NO: 1029 - protein, 8 aa, Artificial sequence
  an artificially synthesized sequence
PSGRSANY

SEQ ID NO: 1030 - protein, 8 aa, Artificial sequence
  an artificially synthesized sequence
PSGRSANV

SEQ ID NO: 1031 - protein, 8 aa, Artificial sequence
  an artificially synthesized sequence
PSGRSANH

SEQ ID NO: 1032 - protein, 8 aa, Artificial sequence
  an artificially synthesized sequence
ATGRSANP

SEQ ID NO: 1033 - protein, 8 aa, Artificial sequence
  an artificially synthesized sequence
AKGRSANP

SEQ ID NO: 1034 - protein, 8 aa, Artificial sequence
  an artificially synthesized sequence
ASGRSAIP

SEQ ID NO: 1035 - protein, 8 aa, Artificial sequence
  an artificially synthesized sequence
ASGRSATP

SEQ ID NO: 1036 - protein, 8 aa, Artificial sequence
  an artificially synthesized sequence
ASGRSASP

SEQ ID NO: 1037 - protein, 8 aa, Artificial sequence
  an artificially synthesized sequence
ASGRSAHP

SEQ ID NO: 1038 - protein, 8 aa, Artificial sequence
  an artificially synthesized sequence
ASGRSANY

SEQ ID NO: 1039 - protein, 8 aa, Artificial sequence
  an artificially synthesized sequence
ASGRSANV

SEQ ID NO: 1040 - protein, 8 aa, Artificial sequence
  an artificially synthesized sequence
ASGRSANH

SEQ ID NO: 1041 - protein, 8 aa, Artificial sequence
  an artificially synthesized sequence
YTGRSANP

SEQ ID NO: 1042 - protein, 8 aa, Artificial sequence
  an artificially synthesized sequence
YKGRSANP

SEQ ID NO: 1043 - protein, 8 aa, Artificial sequence
  an artificially synthesized sequence
YSGRSAVP

SEQ ID NO: 1044 - protein, 8 aa, Artificial sequence
  an artificially synthesized sequence
YSGRSAIP

SEQ ID NO: 1045 - protein, 8 aa, Artificial sequence
  an artificially synthesized sequence
YSGRSATP

SEQ ID NO: 1046 - protein, 8 aa, Artificial sequence
  an artificially synthesized sequence
YSGRSASP

SEQ ID NO: 1047 - protein, 8 aa, Artificial sequence
  an artificially synthesized sequence
YSGRSAHP

SEQ ID NO: 1048 - protein, 8 aa, Artificial sequence
  an artificially synthesized sequence
YSGRSANA

SEQ ID NO: 1049 - protein, 8 aa, Artificial sequence
  an artificially synthesized sequence
YSGRSANF

SEQ ID NO: 1050 - protein, 8 aa, Artificial sequence
  an artificially synthesized sequence
YSGRSANY

SEQ ID NO: 1051 - protein, 8 aa, Artificial sequence
  an artificially synthesized sequence
YSGRSANV

SEQ ID NO: 1052 - protein, 8 aa, Artificial sequence
  an artificially synthesized sequence
YSGRSANH

SEQ ID NO: 1053 - protein, 8 aa, Artificial sequence
  an artificially synthesized sequence
STGRSANP

SEQ ID NO: 1054 - protein, 8 aa, Artificial sequence
  an artificially synthesized sequence
SKGRSANP

SEQ ID NO: 1055 - protein, 8 aa, Artificial sequence
  an artificially synthesized sequence
SSGRSAVP

SEQ ID NO: 1056 - protein, 8 aa, Artificial sequence
  an artificially synthesized sequence
SSGRSAIP

SEQ ID NO: 1057 - protein, 8 aa, Artificial sequence
  an artificially synthesized sequence
SSGRSATP

SEQ ID NO: 1058 - protein, 8 aa, Artificial sequence
  an artificially synthesized sequence
SSGRSASP

SEQ ID NO: 1059 - protein, 8 aa, Artificial sequence
  an artificially synthesized sequence
SSGRSAHP

SEQ ID NO: 1060 - protein, 8 aa, Artificial sequence
  an artificially synthesized sequence
SSGRSANA

SEQ ID NO: 1061 - protein, 8 aa, Artificial sequence
  an artificially synthesized sequence
SSGRSANF

SEQ ID NO: 1062 - protein, 8 aa, Artificial sequence
  an artificially synthesized sequence
SSGRSANY

SEQ ID NO: 1063 - protein, 8 aa, Artificial sequence
  an artificially synthesized sequence
SSGRSANV

SEQ ID NO: 1064 - protein, 8 aa, Artificial sequence
  an artificially synthesized sequence
SSGRSANH

SEQ ID NO: 1065 - protein, 8 aa, Artificial sequence
  an artificially synthesized sequence
ITGRSANP

SEQ ID NO: 1066 - protein, 8 aa, Artificial sequence
  an artificially synthesized sequence
IKGRSANP

SEQ ID NO: 1067 - protein, 8 aa, Artificial sequence
  an artificially synthesized sequence
ISGRSAVP

SEQ ID NO: 1068 - protein, 8 aa, Artificial sequence
  an artificially synthesized sequence
ISGRSAIP

SEQ ID NO: 1069 - protein, 8 aa, Artificial sequence
  an artificially synthesized sequence
ISGRSATP

SEQ ID NO: 1070 - protein, 8 aa, Artificial sequence
  an artificially synthesized sequence
ISGRSASP

SEQ ID NO: 1071 - protein, 8 aa, Artificial sequence
  an artificially synthesized sequence
ISGRSAHP

SEQ ID NO: 1072 - protein, 8 aa, Artificial sequence
  an artificially synthesized sequence
ISGRSANA

SEQ ID NO: 1073 - protein, 8 aa, Artificial sequence
  an artificially synthesized sequence
ISGRSANF

SEQ ID NO: 1074 - protein, 8 aa, Artificial sequence
  an artificially synthesized sequence
ISGRSANY

SEQ ID NO: 1075 - protein, 8 aa, Artificial sequence
  an artificially synthesized sequence
ISGRSANV

SEQ ID NO: 1076 - protein, 8 aa, Artificial sequence
  an artificially synthesized sequence
ISGRSANH

SEQ ID NO: 1077 - protein, 8 aa, Artificial sequence
  an artificially synthesized sequence
TTGRSAVP

SEQ ID NO: 1078 - protein, 8 aa, Artificial sequence
  an artificially synthesized sequence
TTGRSAIP

SEQ ID NO: 1079 - protein, 8 aa, Artificial sequence
  an artificially synthesized sequence
TTGRSATP

SEQ ID NO: 1080 - protein, 8 aa, Artificial sequence
  an artificially synthesized sequence
TTGRSASP

SEQ ID NO: 1081 - protein, 8 aa, Artificial sequence
  an artificially synthesized sequence
TTGRSAHP

SEQ ID NO: 1082 - protein, 8 aa, Artificial sequence
  an artificially synthesized sequence
TTGRSANA

SEQ ID NO: 1083 - protein, 8 aa, Artificial sequence
  an artificially synthesized sequence
TTGRSANF

SEQ ID NO: 1084 - protein, 8 aa, Artificial sequence
  an artificially synthesized sequence
TTGRSANY

SEQ ID NO: 1085 - protein, 8 aa, Artificial sequence
  an artificially synthesized sequence
TTGRSANV

SEQ ID NO: 1086 - protein, 8 aa, Artificial sequence
  an artificially synthesized sequence
TTGRSANH

SEQ ID NO: 1087 - protein, 8 aa, Artificial sequence
  an artificially synthesized sequence
TKGRSAVP

SEQ ID NO: 1088 - protein, 8 aa, Artificial sequence
  an artificially synthesized sequence
TKGRSAIP

SEQ ID NO: 1089 - protein, 8 aa, Artificial sequence
  an artificially synthesized sequence
TKGRSATP

SEQ ID NO: 1090 - protein, 8 aa, Artificial sequence
  an artificially synthesized sequence
TKGRSASP

SEQ ID NO: 1091 - protein, 8 aa, Artificial sequence
  an artificially synthesized sequence
TKGRSAHP

SEQ ID NO: 1092 - protein, 8 aa, Artificial sequence
  an artificially synthesized sequence
TKGRSANA

SEQ ID NO: 1093 - protein, 8 aa, Artificial sequence
  an artificially synthesized sequence
TKGRSANF

SEQ ID NO: 1094 - protein, 8 aa, Artificial sequence
  an artificially synthesized sequence
TKGRSANY

SEQ ID NO: 1095 - protein, 8 aa, Artificial sequence
  an artificially synthesized sequence
TKGRSANV

SEQ ID NO: 1096 - protein, 8 aa, Artificial sequence
  an artificially synthesized sequence
TKGRSANH

SEQ ID NO: 1097 - protein, 8 aa, Artificial sequence
  an artificially synthesized sequence
TSGRSAVY

SEQ ID NO: 1098 - protein, 8 aa, Artificial sequence
  an artificially synthesized sequence
TSGRSAVV

SEQ ID NO: 1099 - protein, 8 aa, Artificial sequence
  an artificially synthesized sequence
TSGRSAVH

SEQ ID NO: 1100 - protein, 8 aa, Artificial sequence
  an artificially synthesized sequence
TSGRSAIY

SEQ ID NO: 1101 - protein, 8 aa, Artificial sequence
  an artificially synthesized sequence
TSGRSAIV

SEQ ID NO: 1102 - protein, 8 aa, Artificial sequence
  an artificially synthesized sequence
TSGRSAIH

SEQ ID NO: 1103 - protein, 8 aa, Artificial sequence
  an artificially synthesized sequence
TSGRSASY

SEQ ID NO: 1104 - protein, 8 aa, Artificial sequence
  an artificially synthesized sequence
TSGRSASV

SEQ ID NO: 1105 - protein, 8 aa, Artificial sequence
  an artificially synthesized sequence
TSGRSASH

SEQ ID NO: 1106 - protein, 8 aa, Artificial sequence
  an artificially synthesized sequence
TSGRSAHY

SEQ ID NO: 1107 - protein, 8 aa, Artificial sequence
  an artificially synthesized sequence
TSGRSAHV

SEQ ID NO: 1108 - protein, 8 aa, Artificial sequence
  an artificially synthesized sequence
TSGRSAHH

SEQ ID NO: 1109 - protein, 8 aa, Artificial sequence
  an artificially synthesized sequence
PSGRSEVP

SEQ ID NO: 1110 - protein, 8 aa, Artificial sequence
  an artificially synthesized sequence
PSGRSAEP

SEQ ID NO: 1111 - protein, 8 aa, Artificial sequence
  an artificially synthesized sequence
PSGRSAGP

SEQ ID NO: 1112 - protein, 8 aa, Artificial sequence
  an artificially synthesized sequence
ASGRSENA

SEQ ID NO: 1113 - protein, 8 aa, Artificial sequence
  an artificially synthesized sequence
ASGRSAEA

SEQ ID NO: 1114 - protein, 8 aa, Artificial sequence
  an artificially synthesized sequence
ASGRSAGA

SEQ ID NO: 1115 - protein, 8 aa, Artificial sequence
  an artificially synthesized sequence
GTGRSATP

SEQ ID NO: 1116 - protein, 8 aa, Artificial sequence
  an artificially synthesized sequence
GSGRSATY

SEQ ID NO: 1117 - protein, 8 aa, Artificial sequence
  an artificially synthesized sequence
GSGRSATV

SEQ ID NO: 1118 - protein, 8 aa, Artificial sequence
  an artificially synthesized sequence
GSGRSATH

SEQ ID NO: 1119 - protein, 8 aa, Artificial sequence
  an artificially synthesized sequence
GTGRSATY

SEQ ID NO: 1120 - protein, 8 aa, Artificial sequence
  an artificially synthesized sequence
GTGRSATV

SEQ ID NO: 1121 - protein, 8 aa, Artificial sequence
  an artificially synthesized sequence
GTGRSATH

SEQ ID NO: 1122 - protein, 8 aa, Artificial sequence
  an artificially synthesized sequence
GSGRSETP

SEQ ID NO: 1123 - protein, 8 aa, Artificial sequence
  an artificially synthesized sequence
GTGRSETP

SEQ ID NO: 1124 - protein, 8 aa, Artificial sequence
  an artificially synthesized sequence
GSGRSETY

SEQ ID NO: 1125 - protein, 8 aa, Artificial sequence
  an artificially synthesized sequence
GSGRSETV

SEQ ID NO: 1126 - protein, 8 aa, Artificial sequence
  an artificially synthesized sequence
GSGRSETH

SEQ ID NO: 1127 - protein, 8 aa, Artificial sequence
  an artificially synthesized sequence
YTGRSAVP

SEQ ID NO: 1128 - protein, 8 aa, Artificial sequence
  an artificially synthesized sequence
YSGRSAVY

SEQ ID NO: 1129 - protein, 8 aa, Artificial sequence
  an artificially synthesized sequence
YSGRSAVV

SEQ ID NO: 1130 - protein, 8 aa, Artificial sequence
  an artificially synthesized sequence
YSGRSAVH

SEQ ID NO: 1131 - protein, 8 aa, Artificial sequence
  an artificially synthesized sequence
YTGRSAVY

SEQ ID NO: 1132 - protein, 8 aa, Artificial sequence
  an artificially synthesized sequence
YTGRSAVV

SEQ ID NO: 1133 - protein, 8 aa, Artificial sequence
  an artificially synthesized sequence
YTGRSAVH

SEQ ID NO: 1134 - protein, 8 aa, Artificial sequence
  an artificially synthesized sequence
YSGRSEVP

SEQ ID NO: 1135 - protein, 8 aa, Artificial sequence
  an artificially synthesized sequence
YTGRSEVP

SEQ ID NO: 1136 - protein, 8 aa, Artificial sequence
  an artificially synthesized sequence
YSGRSEVY

SEQ ID NO: 1137 - protein, 8 aa, Artificial sequence
  an artificially synthesized sequence
YSGRSEVV

SEQ ID NO: 1138 - protein, 8 aa, Artificial sequence
  an artificially synthesized sequence
YSGRSEVH

SEQ ID NO: 1139 - protein, 8 aa, Artificial sequence
  an artificially synthesized sequence
YTGRSAVP

SEQ ID NO: 1140 - protein, 8 aa, Artificial sequence
  an artificially synthesized sequence
YSGRSAVY

SEQ ID NO: 1141 - protein, 8 aa, Artificial sequence
  an artificially synthesized sequence
YSGRSAVV

SEQ ID NO: 1142 - protein, 8 aa, Artificial sequence
  an artificially synthesized sequence
YSGRSAVH

SEQ ID NO: 1143 - protein, 8 aa, Artificial sequence
  an artificially synthesized sequence
YTGRSAVY

SEQ ID NO: 1144 - protein, 8 aa, Artificial sequence
  an artificially synthesized sequence
YTGRSAVV

SEQ ID NO: 1145 - protein, 8 aa, Artificial sequence
  an artificially synthesized sequence
YTGRSAVH

SEQ ID NO: 1146 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSTSGRSANPRGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1147 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVPRGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1148 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVYRGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1149 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVVRGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1150 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVHRGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1151 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVYRGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1152 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVVRGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1153 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVHRGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1154 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVPGGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1155 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVYGGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1156 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVVGGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1157 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVHGGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1158 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVYGGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1159 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVVGGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1160 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVHGGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1161-1180 - skipped (20 entries)

SEQ ID NO: 1181 - protein, 462 aa, Artificial sequence; identical to SEQ ID NO: 368
  an artificially synthesized sequence

SEQ ID NO: 1182 - protein, 216 aa, Artificial sequence; identical to SEQ ID NO: 369
  an artificially synthesized sequence

SEQ ID NO: 1183 - protein, 12 aa, Artificial sequence
  an artificially synthesized sequence
TSTSGRSANPRG

SEQ ID NO: 1184 - protein, 12 aa, Artificial sequence
  an artificially synthesized sequence
TSTSGRSANPAG

SEQ ID NO: 1185 - protein, 12 aa, Artificial sequence
  an artificially synthesized sequence
TSTSGRSANPHG

SEQ ID NO: 1186 - protein, 12 aa, Artificial sequence
  an artificially synthesized sequence
TSTSGRSANPIG

SEQ ID NO: 1187 - protein, 12 aa, Artificial sequence
  an artificially synthesized sequence
TSTSGRSANPLG

SEQ ID NO: 1188 - protein, 12 aa, Artificial sequence
  an artificially synthesized sequence
TSTSGRSANPSG

SEQ ID NO: 1189 - protein, 12 aa, Artificial sequence
  an artificially synthesized sequence
ISTSGRSANPIG

SEQ ID NO: 1190 - protein, 12 aa, Artificial sequence
  an artificially synthesized sequence
YSTSGRSANPIG

SEQ ID NO: 1191 - protein, 12 aa, Artificial sequence
  an artificially synthesized sequence
TSYSGRSAVPAG

SEQ ID NO: 1192 - protein, 12 aa, Artificial sequence
  an artificially synthesized sequence
TSPSGRSANIAG

SEQ ID NO: 1193 - protein, 12 aa, Artificial sequence
  an artificially synthesized sequence
TSPSGRSANFAG

SEQ ID NO: 1194 - protein, 12 aa, Artificial sequence
  an artificially synthesized sequence
TSPTGRSANPAG

SEQ ID NO: 1195 - protein, 12 aa, Artificial sequence
  an artificially synthesized sequence
TSPSGRSAIPAG

SEQ ID NO: 1196 - protein, 12 aa, Artificial sequence
  an artificially synthesized sequence
TSYTGRSANPAG

SEQ ID NO: 1197 - protein, 12 aa, Artificial sequence
  an artificially synthesized sequence
TSYSGRSAIPAG

SEQ ID NO: 1198 - protein, 12 aa, Artificial sequence
  an artificially synthesized sequence
TSISGRSANYAG

SEQ ID NO: 1199 - protein, 12 aa, Artificial sequence
  an artificially synthesized sequence
TSPSGRSAGPAG

SEQ ID NO: 1200 - protein, 12 aa, Artificial sequence
  an artificially synthesized sequence
TSYTGRSAVPAG

SEQ ID NO: 1201 - protein, 12 aa, Artificial sequence
  an artificially synthesized sequence
TSYTGRSAVYAG

SEQ ID NO: 1202 - protein, 12 aa, Artificial sequence
  an artificially synthesized sequence
TSYTGRSAVVAG

SEQ ID NO: 1203 - protein, 12 aa, Artificial sequence
  an artificially synthesized sequence
TSYTGRSAVHAG

SEQ ID NO: 1204 - protein, 12 aa, Artificial sequence
  an artificially synthesized sequence
TSYSGRSAVPHG

SEQ ID NO: 1205 - protein, 12 aa, Artificial sequence
  an artificially synthesized sequence
TSPSGRSANIHG

SEQ ID NO: 1206 - protein, 12 aa, Artificial sequence
  an artificially synthesized sequence
TSPSGRSANFHG

SEQ ID NO: 1207 - protein, 12 aa, Artificial sequence
  an artificially synthesized sequence
TSPTGRSANPHG

SEQ ID NO: 1208 - protein, 12 aa, Artificial sequence
  an artificially synthesized sequence
TSPSGRSAIPHG

SEQ ID NO: 1209 - protein, 12 aa, Artificial sequence
  an artificially synthesized sequence
TSYTGRSANPHG

SEQ ID NO: 1210 - protein, 12 aa, Artificial sequence
  an artificially synthesized sequence
TSYSGRSAIPHG

SEQ ID NO: 1211 - protein, 12 aa, Artificial sequence
  an artificially synthesized sequence
TSISGRSANYHG

SEQ ID NO: 1212 - protein, 12 aa, Artificial sequence
  an artificially synthesized sequence
TSPSGRSAGPHG

SEQ ID NO: 1213 - protein, 12 aa, Artificial sequence
  an artificially synthesized sequence
TSYTGRSAVPHG

SEQ ID NO: 1214 - protein, 12 aa, Artificial sequence
  an artificially synthesized sequence
TSYTGRSAVYHG

SEQ ID NO: 1215 - protein, 12 aa, Artificial sequence
  an artificially synthesized sequence
TSYTGRSAVVHG

SEQ ID NO: 1216 - protein, 12 aa, Artificial sequence
  an artificially synthesized sequence
TSYTGRSAVHHG

SEQ ID NO: 1217 - protein, 12 aa, Artificial sequence
  an artificially synthesized sequence
TSYSGRSAVPIG

SEQ ID NO: 1218 - protein, 12 aa, Artificial sequence
  an artificially synthesized sequence
TSPSGRSANIIG

SEQ ID NO: 1219 - protein, 12 aa, Artificial sequence
  an artificially synthesized sequence
TSPSGRSANFIG

SEQ ID NO: 1220 - protein, 12 aa, Artificial sequence
  an artificially synthesized sequence
TSPTGRSANPIG

SEQ ID NO: 1221 - protein, 12 aa, Artificial sequence
  an artificially synthesized sequence
TSPSGRSAIPIG

SEQ ID NO: 1222 - protein, 12 aa, Artificial sequence
  an artificially synthesized sequence
TSYTGRSANPIG

SEQ ID NO: 1223 - protein, 12 aa, Artificial sequence
  an artificially synthesized sequence
TSYSGRSAIPIG

SEQ ID NO: 1224 - protein, 12 aa, Artificial sequence
  an artificially synthesized sequence
TSISGRSANYIG

SEQ ID NO: 1225 - protein, 12 aa, Artificial sequence
  an artificially synthesized sequence
TSPSGRSAGPIG

SEQ ID NO: 1226 - protein, 12 aa, Artificial sequence
  an artificially synthesized sequence
TSYTGRSAVPIG

SEQ ID NO: 1227 - protein, 12 aa, Artificial sequence
  an artificially synthesized sequence
TSYTGRSAVYIG

SEQ ID NO: 1228 - protein, 12 aa, Artificial sequence
  an artificially synthesized sequence
TSYTGRSAVVIG

SEQ ID NO: 1229 - protein, 12 aa, Artificial sequence
  an artificially synthesized sequence
TSYTGRSAVHIG

SEQ ID NO: 1230 - protein, 12 aa, Artificial sequence
  an artificially synthesized sequence
TSYSGRSAVPLG

SEQ ID NO: 1231 - protein, 12 aa, Artificial sequence
  an artificially synthesized sequence
TSPSGRSANILG

SEQ ID NO: 1232 - protein, 12 aa, Artificial sequence
  an artificially synthesized sequence
TSPSGRSANFLG

SEQ ID NO: 1233 - protein, 12 aa, Artificial sequence
  an artificially synthesized sequence
TSPTGRSANPLG

SEQ ID NO: 1234 - protein, 12 aa, Artificial sequence
  an artificially synthesized sequence
TSPSGRSAIPLG

SEQ ID NO: 1235 - protein, 12 aa, Artificial sequence
  an artificially synthesized sequence
TSYTGRSANPLG

SEQ ID NO: 1236 - protein, 12 aa, Artificial sequence
  an artificially synthesized sequence
TSYSGRSAIPLG

SEQ ID NO: 1237 - protein, 12 aa, Artificial sequence
  an artificially synthesized sequence
TSISGRSANYLG

SEQ ID NO: 1238 - protein, 12 aa, Artificial sequence
  an artificially synthesized sequence
TSPSGRSAGPLG

SEQ ID NO: 1239 - protein, 12 aa, Artificial sequence
  an artificially synthesized sequence
TSYTGRSAVPLG

SEQ ID NO: 1240 - protein, 12 aa, Artificial sequence
  an artificially synthesized sequence
TSYTGRSAVYLG

SEQ ID NO: 1241 - protein, 12 aa, Artificial sequence
  an artificially synthesized sequence
TSYTGRSAVVLG

SEQ ID NO: 1242 - protein, 12 aa, Artificial sequence
  an artificially synthesized sequence
TSYTGRSAVHLG

SEQ ID NO: 1243 - protein, 12 aa, Artificial sequence
  an artificially synthesized sequence
TSYSGRSAVPSG

SEQ ID NO: 1244 - protein, 12 aa, Artificial sequence
  an artificially synthesized sequence
TSPSGRSANISG

SEQ ID NO: 1245 - protein, 12 aa, Artificial sequence
  an artificially synthesized sequence
TSPSGRSANFSG

SEQ ID NO: 1246 - protein, 12 aa, Artificial sequence
  an artificially synthesized sequence
TSPTGRSANPSG

SEQ ID NO: 1247 - protein, 12 aa, Artificial sequence
  an artificially synthesized sequence
TSPSGRSAIPSG

SEQ ID NO: 1248 - protein, 12 aa, Artificial sequence
  an artificially synthesized sequence
TSYTGRSANPSG

SEQ ID NO: 1249 - protein, 12 aa, Artificial sequence
  an artificially synthesized sequence
TSYSGRSAIPSG

SEQ ID NO: 1250 - protein, 12 aa, Artificial sequence
  an artificially synthesized sequence
TSISGRSANYSG

SEQ ID NO: 1251 - protein, 12 aa, Artificial sequence
  an artificially synthesized sequence
TSPSGRSAGPSG

SEQ ID NO: 1252 - protein, 12 aa, Artificial sequence
  an artificially synthesized sequence
TSYTGRSAVPSG

SEQ ID NO: 1253 - protein, 12 aa, Artificial sequence
  an artificially synthesized sequence
TSYTGRSAVYSG

SEQ ID NO: 1254 - protein, 12 aa, Artificial sequence
  an artificially synthesized sequence
TSYTGRSAVVSG

SEQ ID NO: 1255 - protein, 12 aa, Artificial sequence
  an artificially synthesized sequence
TSYTGRSAVHSG

SEQ ID NO: 1256 - protein, 12 aa, Artificial sequence
  an artificially synthesized sequence
ISYSGRSAVPIG

SEQ ID NO: 1257 - protein, 12 aa, Artificial sequence
  an artificially synthesized sequence
ISPSGRSANIIG

SEQ ID NO: 1258 - protein, 12 aa, Artificial sequence
  an artificially synthesized sequence
ISPSGRSANFIG

SEQ ID NO: 1259 - protein, 12 aa, Artificial sequence
  an artificially synthesized sequence
ISPTGRSANPIG

SEQ ID NO: 1260 - protein, 12 aa, Artificial sequence
  an artificially synthesized sequence
ISPSGRSAIPIG

SEQ ID NO: 1261 - protein, 12 aa, Artificial sequence
  an artificially synthesized sequence
ISYTGRSANPIG

SEQ ID NO: 1262 - protein, 12 aa, Artificial sequence
  an artificially synthesized sequence
ISYSGRSAIPIG

SEQ ID NO: 1263 - protein, 12 aa, Artificial sequence
  an artificially synthesized sequence
ISISGRSANYIG

SEQ ID NO: 1264 - protein, 12 aa, Artificial sequence
  an artificially synthesized sequence
ISPSGRSAGPIG

SEQ ID NO: 1265 - protein, 12 aa, Artificial sequence
  an artificially synthesized sequence
ISYTGRSAVPIG

SEQ ID NO: 1266 - protein, 12 aa, Artificial sequence
  an artificially synthesized sequence
ISYTGRSAVYIG

SEQ ID NO: 1267 - protein, 12 aa, Artificial sequence
  an artificially synthesized sequence
ISYTGRSAVVIG

SEQ ID NO: 1268 - protein, 12 aa, Artificial sequence
  an artificially synthesized sequence
ISYTGRSAVHIG

SEQ ID NO: 1269 - protein, 12 aa, Artificial sequence
  an artificially synthesized sequence
YSYSGRSAVPIG

SEQ ID NO: 1270 - protein, 12 aa, Artificial sequence
  an artificially synthesized sequence
YSPSGRSANIIG

SEQ ID NO: 1271 - protein, 12 aa, Artificial sequence
  an artificially synthesized sequence
YSPSGRSANFIG

SEQ ID NO: 1272 - protein, 12 aa, Artificial sequence
  an artificially synthesized sequence
YSPTGRSANPIG

SEQ ID NO: 1273 - protein, 12 aa, Artificial sequence
  an artificially synthesized sequence
YSPSGRSAIPIG

SEQ ID NO: 1274 - protein, 12 aa, Artificial sequence
  an artificially synthesized sequence
YSYTGRSANPIG

SEQ ID NO: 1275 - protein, 12 aa, Artificial sequence
  an artificially synthesized sequence
YSYSGRSAIPIG

SEQ ID NO: 1276 - protein, 12 aa, Artificial sequence
  an artificially synthesized sequence
YSISGRSANYIG

SEQ ID NO: 1277 - protein, 12 aa, Artificial sequence
  an artificially synthesized sequence
YSPSGRSAGPIG

SEQ ID NO: 1278 - protein, 12 aa, Artificial sequence
  an artificially synthesized sequence
YSYTGRSAVPIG

SEQ ID NO: 1279 - protein, 12 aa, Artificial sequence
  an artificially synthesized sequence
YSYTGRSAVYIG

SEQ ID NO: 1280 - protein, 12 aa, Artificial sequence
  an artificially synthesized sequence
YSYTGRSAVVIG

SEQ ID NO: 1281 - protein, 12 aa, Artificial sequence
  an artificially synthesized sequence
YSYTGRSAVHIG

SEQ ID NO: 1282 - protein, 228 aa, Artificial sequence; identical to SEQ ID NO: 1146
  an artificially synthesized sequence

SEQ ID NO: 1283 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSTSGRSANPAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1284 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSTSGRSANPHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1285 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSTSGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1286 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSTSGRSANPLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1287 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSTSGRSANPSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1288 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISTSGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1289 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSTSGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1290 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVPAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1291 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANIAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1292 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANFAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1293 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPTGRSANPAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1294 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAIPAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1295 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSANPAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1296 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAIPAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1297 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSISGRSANYAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1298 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAGPAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1299 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVPAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1300 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVYAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1301 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVVAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1302 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVHAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1303 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVPHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1304 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANIHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1305 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANFHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1306 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPTGRSANPHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1307 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAIPHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1308 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSANPHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1309 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAIPHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1310 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSISGRSANYHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1311 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAGPHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1312 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVPHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1313 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVYHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1314 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVVHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1315 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVHHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1316 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1317 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANIIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1318 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANFIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1319 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPTGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1320 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAIPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1321 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1322 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAIPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1323 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSISGRSANYIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1324 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAGPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1325 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1326 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVYIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1327 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVVIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1328 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVHIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1329 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVPLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1330 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANILGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1331 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANFLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1332 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPTGRSANPLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1333 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAIPLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1334 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSANPLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1335 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAIPLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1336 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSISGRSANYLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1337 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAGPLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1338 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVPLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1339 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVYLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1340 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVVLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1341 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVHLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1342 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVPSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1343 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANISGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1344 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANFSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1345 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPTGRSANPSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1346 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAIPSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1347 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSANPSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1348 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAIPSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1349 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSISGRSANYSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1350 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAGPSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1351 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVPSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1352 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVYSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1353 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVVSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1354 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVHSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1355 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISYSGRSAVPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1356 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISPSGRSANIIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1357 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISPSGRSANFIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1358 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISPTGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1359 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISPSGRSAIPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1360 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISYTGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1361 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISYSGRSAIPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1362 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISISGRSANYIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1363 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISPSGRSAGPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1364 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISYTGRSAVPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1365 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISYTGRSAVYIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1366 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISYTGRSAVVIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1367 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISYTGRSAVHIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1368 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSYSGRSAVPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1369 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSPSGRSANIIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1370 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSPSGRSANFIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1371 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSPTGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1372 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSPSGRSAIPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1373 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSYTGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1374 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSYSGRSAIPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1375 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSISGRSANYIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1376 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSPSGRSAGPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1377 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSYTGRSAVPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1378 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSYTGRSAVYIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1379 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSYTGRSAVVIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1380 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSYTGRSAVHIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1381 - protein, 462 aa, Artificial sequence
  an artificially synthesized sequence
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPYLDSDGSFFLYSKLTVDKSRWQQGNVFSCSVMHEALHNHYTQKSLSLSP

SEQ ID NO: 1382 - protein, 12 aa, Artificial sequence
  an artificially synthesized sequence
TSYTGRSAVPRG

SEQ ID NO: 1383 - protein, 12 aa, Artificial sequence
  an artificially synthesized sequence
TSYSGRSAVVRG

SEQ ID NO: 1384 - protein, 12 aa, Artificial sequence
  an artificially synthesized sequence
TSYTGRSAVYRG

SEQ ID NO: 1385 - protein, 12 aa, Artificial sequence
  an artificially synthesized sequence
TSYTGRSAVHRG

SEQ ID NO: 1386 - protein, 228 aa, Artificial sequence; identical to SEQ ID NO: 1147
  an artificially synthesized sequence

SEQ ID NO: 1387 - protein, 228 aa, Artificial sequence; identical to SEQ ID NO: 1149
  an artificially synthesized sequence

SEQ ID NO: 1388 - protein, 228 aa, Artificial sequence; identical to SEQ ID NO: 1151
  an artificially synthesized sequence

SEQ ID NO: 1389 - protein, 228 aa, Artificial sequence; identical to SEQ ID NO: 1153
  an artificially synthesized sequence

SEQ ID NO: 1390 - protein, 444 aa, Artificial sequence
  an artificially synthesized sequence
QVQLQQSGPQLVRPGASVKISCKASGYSFTSYWMHWVNQRPGQGLEWIGMIDPSYSETRLNQKFKDKATLTVDKSSSTAYMQLSSPTSEDSAVYYCALYGNYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 1391 - protein, 214 aa, Artificial sequence
  an artificially synthesized sequence
DIQMTQSSSSFSVSLGDRVTITCKASEDIYNRLAWYQQKPGNAPRLLISGATSLETGVPSRFSGSGSGKDYTLSITSLQTEDVATYYCQQYWSTPYTFGGGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

The invention claimed is:

1. A ligand-binding molecule which is capable of binding to a ligand, wherein the molecule is a polypeptide comprising at least one protease cleavage sequence comprising one or more sequences selected from the sequences shown in SEQ ID NOs: 338, 335, 336, 337, 339-344, and 538-1145 wherein the binding of the ligand-binding molecule to the ligand in a state where the protease cleavage sequence is cleaved is weaker than the binding of the ligand-binding molecule to the ligand in a state where the protease cleavage sequence is uncleaved, and wherein the ligand is:
   (a) a cytokine or a chemokine;
   (b) an interleukin, an interferon, a hematopoietic factor, a TNF superfamily member, a cell growth factor, or a TGF-β family member; or
   (c) CXCL10, IL12, PD1, or IL6R.

2. The ligand-binding molecule of claim 1, wherein the ligand is bound, complexed, or fused to the ligand-binding molecule in a state where the protease cleavage sequence is uncleaved, and wherein the ligand is released from the ligand-binding molecule in a state where the protease cleavage sequence is cleaved.

3. The ligand-binding molecule of claim 1, wherein the protease is a human urokinase (huPA) or human matriptase (hMT-SP1).

4. The ligand-binding molecule of claim 1, which comprises an antibody VH, an antibody VL, and an antibody constant region.

5. The ligand-binding molecule of claim 4, wherein the protease cleavage sequence is located near the boundary between the antibody constant region and the antibody VH, and/or near the boundary between the antibody constant region and the antibody VL.

6. The ligand-binding molecule of claim 4, wherein the antibody VL and the antibody VH in the ligand-binding molecule are associated with each other, and the association is eliminated by cleavage of the protease cleavage sequence with the protease.

7. The ligand-binding molecule of claim 1, wherein the ligand-binding molecule inhibits an activity of the ligand by binding to the ligand.

8. The ligand-binding molecule of claim 1, wherein the ligand-binding molecule is an IgG antibody.

9. A complex comprising the ligand-binding molecule of claim 1 and the ligand.

10. A pharmaceutical composition comprising the complex of claim 9.

11. A polynucleotide encoding the complex of claim 9.

12. A fusion protein comprising the ligand-binding molecule of claim 1 fused with the ligand.

13. A pharmaceutical composition comprising the fusion protein of claim 12.

14. A polynucleotide encoding the fusion protein of claim 12.

15. A pharmaceutical composition comprising the ligand-binding molecule of claim 1.

16. A polynucleotide encoding the ligand-binding molecule of claim 1.

17. A vector comprising the polynucleotide of claim 16.

18. A host cell comprising the polynucleotide of claim 16.

* * * * *